United States Patent
Hunt et al.

(10) Patent No.: US 9,561,266 B2
(45) Date of Patent: Feb. 7, 2017

(54) TARGET PEPTIDES FOR IMMUNOTHERAPY AND DIAGNOSTICS

(71) Applicants: U.Va. Licensing & Ventures Group, Charlottesville, VA (US); The University of Birmingham, Birmingham (GB)

(72) Inventors: Donald F. Hunt, Charlottesville, VA (US); Jeffrey Shabanowitz, Charlottesville, VA (US); Stacy A. Malaker, Charlottesville, VA (US); Victor H. Engelhard, Crozet, VA (US); Angela Zarling, Richmond, VA (US); Kara L. Cummings, Charlottesville, VA (US); Rebecca C. Obeng, Charlottesville, VA (US); Mark Cobbold, Birmingham (GB)

(73) Assignees: University of Virginia Patent Foundation, Charlottesville, VA (US); The University of Birmingham, Birmingham (GB)

( * ) Notice: Subject to any disclaimer, the term of this patent is extended or adjusted under 35 U.S.C. 154(b) by 0 days.

(21) Appl. No.: 14/424,702

(22) PCT Filed: Sep. 3, 2013

(86) PCT No.: PCT/US2013/057856
§ 371 (c)(1),
(2) Date: Feb. 27, 2015

(87) PCT Pub. No.: WO2014/036562
PCT Pub. Date: Mar. 6, 2014

(65) Prior Publication Data
US 2015/0224182 A1    Aug. 13, 2015

Related U.S. Application Data

(60) Provisional application No. 61/695,776, filed on Aug. 31, 2012, provisional application No. 61/696,787, filed on Sep. 4, 2012.

(51) Int. Cl.
| | | |
|---|---|---|
| *C07K 14/00* | (2006.01) | |
| *A61K 39/00* | (2006.01) | |
| *A61K 35/15* | (2015.01) | |
| *A61K 35/17* | (2015.01) | |
| *A61K 45/06* | (2006.01) | |
| *C07K 16/28* | (2006.01) | |
| *G01N 33/574* | (2006.01) | |
| *G01N 33/68* | (2006.01) | |

(52) U.S. Cl.
CPC ........... *A61K 39/0011* (2013.01); *A61K 35/15* (2013.01); *A61K 35/17* (2013.01); *A61K 45/06* (2013.01); *C07K 16/2809* (2013.01); *C07K 16/2833* (2013.01); *G01N 33/57496* (2013.01); *G01N 33/6863* (2013.01); *A61K 2039/5154* (2013.01); *A61K 2039/5158* (2013.01); *A61K 2039/55516* (2013.01); *A61K 2039/57* (2013.01); *C07K 2317/31* (2013.01)

(58) Field of Classification Search
None
See application file for complete search history.

(56) References Cited

U.S. PATENT DOCUMENTS

| | | |
|---|---|---|
| 6,309,863 B1 | 10/2001 | Anderson et al. |
| 7,166,573 B1 | 1/2007 | Obata |
| 8,124,741 B2 | 2/2012 | Raitano et al. |
| 2004/0086506 A1 | 5/2004 | Haynes et al. |
| 2005/0277161 A1 | 12/2005 | Engelhard et al. |
| 2006/0204509 A1 | 9/2006 | Harty et al. |
| 2006/0251666 A1 | 11/2006 | Nakatsura et al. |
| 2008/0292647 A1 | 11/2008 | Kawakami et al. |
| 2009/0258378 A1 | 10/2009 | Wang et al. |
| 2011/0059463 A1 | 3/2011 | Moritz et al. |
| 2011/0293637 A1 | 12/2011 | Hacohen et al. |
| 2011/0318380 A1 | 12/2011 | Brix et al. |
| 2012/0021432 A1 | 1/2012 | Yu et al. |
| 2012/0129776 A1 | 5/2012 | Cohen et al. |
| 2012/0177669 A1 | 7/2012 | Topalian et al. |
| 2013/0259883 A1 | 10/2013 | Hunt et al. |

(Continued)

FOREIGN PATENT DOCUMENTS

| | | |
|---|---|---|
| EP | 1 536 006 A1 | 6/2005 |
| WO | WO96/40789 | 12/1996 |

(Continued)

OTHER PUBLICATIONS

Engelhard, Current Opinion in Immunology vol. 6 p. 13 (1994).*

(Continued)

*Primary Examiner* — Sheela J Huff
(74) *Attorney, Agent, or Firm* — Jenkins, Wilson, Taylor & Hunt, P.A.

(57) ABSTRACT

A set of target peptides are presented by HLA A*0101, A*0201, A*0301, B*4402, B*2705, B*1402, and B*0702 on the surface of disease cells. They are envisioned to among other things (a) stimulate an immune response to the proliferative disease, e.g., cancer, (b) to function as immunotherapeutics in adoptive T cell therapy or as a vaccine, (c) facilitate antibody recognition of tumor boundaries in surgical pathology samples, (d) act as biomarkers for early detection and/or diagnosis of the disease, and (e) act as targets in the generation antibody-like molecules which recognize the target-peptide/MHC complex.

18 Claims, 50 Drawing Sheets

(56) References Cited

U.S. PATENT DOCUMENTS

| | | |
|---|---|---|
| 2015/0328297 A1 | 11/2015 | Hunt et al. |
| 2016/0000893 A1 | 1/2016 | Hunt et al. |

FOREIGN PATENT DOCUMENTS

| | | | |
|---|---|---|---|
| WO | WO00/73801 | | 12/2000 |
| WO | WO 2009/134883 | | 11/2009 |
| WO | WO2010/129537 | | 11/2010 |
| WO | 2011149909 | * | 12/2011 |
| WO | WO2011/149909 | | 12/2011 |
| WO | WO2013/177593 | | 11/2013 |
| WO | WO 2014/039675 | | 3/2014 |

OTHER PUBLICATIONS

Guo, et al Nature vol. 360 p. 384 (1992).*
Rammensee et al, Immunogenetics vol. 41 p. 178 (1995).*
Shastri et al J. Immunol. vol. 1995 vol. 155 p. 4339.*
Office Action (Restriction Requirement) corresponding to U.S. Appl. No. 14/425,946 dated Nov. 20, 2015.
"CUL4A Antibody" Cell Signaling Technology, Inc. Sep. 16, 2010 <http://www.cellsignal.com/pdf/2699.pdf>.
Altschul S.F. et al., "Basic Local Alignment Search Tool," *Journal of Molecular Biology*, 215:403-410, (1990).
Bullock et al. "Manipulation of avidity to improve effectiveness of adoptively transferred CD8(+) T cells for melanoma immunotherapy in human MHC class I-transgenic mice," J Immunol 167:5824-5831 (2001).
Bystryn et al. "Double-blind trial of a polyvalent, shed-antigen, melanoma vaccine" Clin Cancer Res 7:1882-1887 (2001).
Castelli et al., "T-Cell Recognition of Melanoma-Associated Antigens," *J Cell Physiol*, 182:323-331 (2000).
Chianese-Bullock et al. "Multi-peptide vaccines vialed as peptide mixtures can be stable reagents for use in peptide-based immune therapies" Vaccine 27:1764-1770 (2009).
Cottine, J., et al., "Identification of Novel Class I MHC-Restricted Phosphopeptides for Use as Cancer Immunotherapeutics," 58$^{th}$ Annual ASMS Conference on Mass Spectrometry and Allied Topics, Presentation, May 23-27, 2010, Salt Lake City, Utah.
Engelhard, "Identification of phosphorylated peptide antigens displayed on cancer cells and prospects for their use as immunotherapeutics," Powerpoint Presentation, Eleventh international conference on progress vaccination against cancer (PIVAC-11), Oct. 10-13, 2011, Copenhagen, Denmark.
Engelhard, "The contributions of mass spectrometry to understanding of immune recognition by T lymphocytes," Int J Mass Spectrom 259:32-39 (2007).
Evans, A.M., et al., "Differential Comparison of Phosphorylated MHC Class I HLA-A2.1 Peptides from Three Different Cancer Call Lines," Poster, 50$^{th}$ Annual ASMS Conference on Mass Spectrometry and Allied Topics, Jun. 2-6, 2002, Orlando, Florida.
Ferguson et al. "Strategies and challenges in eliciting immunity to melanoma," Immunol Rev 222:28-42 (2008).
Ficarro, S. B., et al., "Identification of Phosphorylated Peptides Associated with Class I MHC Molecules and Implications for Immunotherapy," Poster, 48th Annual ASMS Conference on Mass Spectrometry and Allied Topics, Jun. 11-15, 2000, Long Beach, California.
Goldman et al. "The cancer vaccine roller coaster," Nat Biotechnol 27:129-139 (2009).
Hawkins, O. E. et al., "Identification of Breast Cancer Peptide Epitopes Presented by HLA-A*0201," *Journal of Proteome Research*, 7:1445-1457 (2008).
Hida et al. A simple culture protocol to detect peptide-specific cytotoxic T lymphocyte precursors in the circulation. Cancer Immunol Immunother 51:219-228 (2002).
Hojlund et al., "In vivo phosphoproteome of human skeletal muscle revealed by phosphopeptide enrichment and HPLC-ESI-MS/MS," *J Proteome Res.*, 8(11):4954-4965 (2009).

Hopkins, L.M., "Sequence analysis of HLA-B7 peptides by ETD mass spectrometry: Comparative analysis of phosphopeptides on cancer and non-cancer cells," Poster, 53$^{rd}$ Annual ASMS Conference on Mass Spectrometry and Allied Topics, Jun. 5-9, 2005, San Antonio, Texas.
Hung et al., "Cul4A is an oncogene in malignant pleural mesothelioma," *J. Cell Mol Med.*, 15(2):350-8 (2011).
Hunt et al. "Characterization of peptides bound to the class I MHC molecule HLA-A2.1 by mass spectrometry," Science 255:1261-1263 (1992).
James, P.F., et al., "Analysis of HLA-A2 MHC Phosphopeptides with Titanium Dioxide, IMAC, Peptide Derivatization and Electron Transfer Dissociation," Poster, 58$^{th}$ Annual ASMS Conference on Mass Spectrometry and Allied Topics, May 23-27, 2010, Salt Lake City, Utah.
Jia et al., "SCF E3 ubiquitin ligases as anticancer targets," *Curr Cancer Drug Targets*, 11(3):347-56 (2011).
Lee et al., "Pathogenic Role of the CRL4 Ubiquitin Ligase in Human Disease," *Front Oncol.*, 2:21:1-7, (2012).
Liu et al., "CUL4A abrogation augments DNA damage response and protection against skin carcinogenesis," *Mol Cell*, 34(4):451-60 (2009).
MacKensen et al. "Phase I study in melanoma patients of a vaccine with peptide-pulsed dendritic cells generated in vitro from CD34(+) hematopoietic progenitor cells," Int J Cancer 86:385-392 (2000).
Meyer et al. (2009) Identification of natural MHC class II presented phosphopeptides and tumor-derived MHC class I phospholigands. J Proteome Res 8:3666-3674.
Morin et al. (1997) Activation of beta-catenin-Tcf signaling in colon cancer by mutations in beta-catenin or APC. Science 275:1787-1790.
Noguchi et al. "Personalized peptide vaccination: a new approach for advanced cancer as therapeutic cancer vaccine," Cancer Immunol Immunother 62:919-929. (2013), Epub Nov. 30, 2012.
Norris, A., "Identification of MHC Class I Phospho-peptide Antigens from Breast Cancer Utilizing sHLA Technology and Complementary Enrichment Strategies," Poster, 58$^{th}$ Annual ASMS Conference on Mass Spectrometry and Allied Topics, May 23-27, 2010, Salt Lake City, Utah.
Norris, A., et al., "The Identification of MHC Class II Peptides Expressed in vivo by B-Cell Leukemias and Lymphomas," Poster, 56$^{th}$ Annual ASMS Conference on Mass Spectrometry and Allied Topics, Jun. 1-8, 2008, Denver, Colorado.
Norris, A., et al., "Utilizing secreted MHC molecules (sHLA) to investigate the phosphor-immuno-peptidome of breast cancer," Poster, 57$^{th}$ Annual ASMS Conference on Mass Spectrometry and Allied Topics, May 31-Jun. 4, 2009, Philadelphia, Pennsylvania.
Ostankovitch et al. "N-glycosylation enhances presentation of a MHC class I-restricted epitope from tyrosinase," J Immunol 182:4830-4835 (2009).
Polefrone, J.M., et al., "Differential Expression of Class I, HLA-A2 Phosphopeptides on Tumor Cells: Characterization of Potential Candidates for Immunotherapy or a Cancer Vaccine," Poster, 53rd Annual ASMS Conference on Mass Spectrometry and Allied Topics, Jun. 5-9, 2005, San Antonio, Texas.
Qian, J., et al., "Analysis of HLA-DR4 restricted peptides by electron transfer dissociation tandem mass spectrometry," Poster, 54$^{th}$ Annual ASMS Conference on Mass Spectrometry and Allied Topics, May 28-Jun. 1, 2006, Seattle, Washington.
Qian, J., et al., "Class I and II MHC restricted phosphopeptides as cancer immunotherapeutics or diagnostics," Poster, 55$^{th}$ Annual ASMS Conference on Mass Spectrometry and Allied Topics, Jun. 3-7, 2007, Indianapolis, Indiana.
Ren et al., "Oncogenic CUL4A determines the response to thalidomide treatment in prostate cancer," *J Mol Med (Berl)*, 90(10):1121-32 (2012).
Rock and Goldberg, "Degradation of Cell Proteins and the Generation of MHC Class I-Presented Peptides," *Annu Rev Immunol*, 17:739-779 (1999).
Schwartzentruber et al. "gp100 peptide vaccine and interleukin-2 in patients with advanced melanoma," N Engl J Med 364:2119-2127 (2011).

(56) References Cited

OTHER PUBLICATIONS

Slingluff "Immunity to melanoma antigens: from self-tolerance to immunotherapy," Adv Immunol 90:243-295 (2006).
Slingluff "Peptide approaches to melanoma vaccines: innovations and challenges," iSTBc/CVC workshop, Alexandria, VA (2005).
Slingluff "The present and future of peptide vaccines for cancer: single or multiple, long or short, alone or in combination?" Cancer J 17:343-350 (2011).
Slingluff et al. "Clinical and immunologic results of a randomized phase II trial of vaccination using four melanoma peptides either administered in granulocyte-macrophage colony-stimulating factor in adjuvant or pulsed on dendritic cells," J Clin Oncol 21:4016-4026 (2003).
The UniProt Consortium, The Universal Protein Resource (UniProt) in 2010, Nucleic Acids Research, 15:D142-D148 (2010).
Tyagi et al. "MAGRIT: The largest-ever phase III lung cancer trial aims to establish a novel tumor-specific approach to therapy," Clin Lung Cancer 10:371-374 (2009).
Wang "Extensive crosstalk between O-GlcNAcylation and phosphorylation regulates cytokinesis," Sci Signal 3:ra2 (2010).
Watts, C., "Capture and Processing of Exogenous Antigens for Presentation on MHC Molecules," *Annu Rev Immunol*, 15:821-850 (1997).
Zarling et al., "Abstract 1584: MHC-restricted phosphopeptides as broad-based immunotherapeutic targets for cancer," Poster Presentations—Tumor Vaccine Development, Proceedings: AACR 103$^{rd}$ Annual Meeting 2010—Mar. 31-Apr. 4, 2012; Chicago, IL, *Cancer Research*, 72(8):Supplement 1 (2012).
Andersen et al. (2001) Induction of Systemic CTL Responses in Melanoma Patients by Dendritic Cell Vaccination: Cessation of CTL Responses is Associated with Disease Progression. Int. J. Cancer, vol. 94 pp. 820-824 (2001).
Bins et al. (2007) Phase I clinical study with multiple peptide vaccines in combination with tetanus toxoid and GM-CSF in advanced-stage HLA-A*0201-positive melanoma patients. J. Immunther. 30(2):234-9.
Cobbold et al. (2005) Adoptive transfer of cytomegalovirus-specific CTL to stem cell transplant patients after selection by HLA-peptide tetramers. J Exp Med 202:379-386.
Cobbold et al. (2013) MHC Class I-Associated Phosphopepetides are the Targets of Memory-like Immunity in Leukemia. Science Translational Medicine, vol. 5, No. 203:203ra125 (Sep. 18, 2013).
Depontieu et al. (2009) Supplemental Information for "Identification of tumor-associated, MHC class II-restricted phosphopeptides as targets for immunotherapy." Proc Natl Acad Sci U S A 106. DOI:10.1073/pnas.0903852106 (7 pages).
Depontieu et al. (2009) Identification of tumor-associated, MHC class II-restricted phosphopeptides as targets for immunotherapy. Proc Natl Acad Sci U S A 106:12073-12078.
Hogan et al. (1998) The peptide recognized by HLA-A68.2-restricted, squamous cell carcinoma of the lung-specific cytotoxic T lymphocytes is derived from a mutated elongation factor 2 gene. Cancer Res 58:5144-5150.
Kielhorn et al. (2003) Tissue microarray-based analysis shows phospho-beta-catenin expression in malignant melanoma is associated with poor outcome. Int J Cancer 103:652-656.

Mohammed et al. (2008) Phosphorylation-dependent interaction between antigenic peptides and MHC class I: a molecular basis for the presentation of transformed self. Nat Immunol 9:1236-1243.
Notification Concerning Transmittal of International Preliminary Report on Patentability (Chapter 1 of the Patent Cooperation Treaty) corresponding to PCT/US2013/057856 mailed Mar. 12, 2015.
Notification Concerning Transmittal of International Preliminary Report on Patentability (Chapter 1 of the Patent Cooperation Treaty) corresponding to PCT/US2013/058255 mailed Apr. 30, 2015.
Notification Concerning Transmittal of International Preliminary Report on Patentability (Chapter 1 of the Patent Cooperation Treaty) corresponding to PCT/US2013/075073 mailed Jun. 25, 2015.
Notification of Transmittal of the International Search Report and the Written Opinion of the International Searching Authority, or the Declaration, corresponding to PCT/US2013/057856 mailed Feb. 28, 2014.
Notification of Transmittal of the International Search Report and the Written Opinion of the International Searching Authority, or the Declaration, corresponding to PCT/US2013/058255 mailed Feb. 21, 2014.
Notification of Transmittal of the International Search Report and the Written Opinion of the International Searching Authority, or the Declaration, corresponding to PCT/US2013/058477 mailed Dec. 20, 2013.
Report and the Written Opinion of the International Searching Authority, or the Declaration, corresponding to PCT/US2013/075073 mailed May 20, 2014.
Petersen et al. (2009) Phosphorylated self-peptides alter human leukocyte antigen class I-restricted antigen presentation and generate tumor-specific epitopes. *Proc Natl Acad Sci U S A* 106:2776-2781.
Slingluff et al. (2011) Randomized multicenter trial of the effects of melanoma-associated helper peptides and cyclophosphamide on the immunogenicity of a multipeptide melanoma vaccine. J Clin Oncol 29(21):2924-2932.
Utz et al. (1997) Proteins phosphorylated during stress-induced apoptosis are common targets for autoantibody production in patients with systemic lupus erythematosus. J Exp Med 185:843-854.
Zarling et al. (2000) Phosphorylated peptides are naturally processed and presented by MHC class I molecules in vivo. J Exp Med 192:1755-1762.
Zarling et al. (2006) Identification of class I MHC associated phosphopeptides as targets for cancer immunotherapy. Proc Natl Acad Sci U S A 103:14889-14894.
European Search Report corresponding to European Patent Application No. 13832812.5-1403/2897631 dated Apr. 28, 2016.
Office Action corresponding to U.S. Appl. No. 14/425,946 dated Mar. 17, 2016.
Communication pursuant to Rule 164(1) EPC for European Patent Application No. 13835570.6 dated Jul. 4, 2016.
Communication of the extended European search report for European Patent Application No. 13862491.1 dated Sep. 19, 2016.
Interview Summary for U.S. Appl. No. 14/425,946 dated Sep. 15, 2016.
Office Action corresponding to U.S. Appl. No. 14/425,946 dated Jun. 24, 2016.

* cited by examiner

| | Number of subjects at risk | | | | | |
|---|---|---|---|---|---|---|
| | 0 | 24 | 48 | 72 | 96 | 120 (mo) |
| Low | 62 | 31 | 10 | 5 | 5 | 3 |
| High | 63 | 26 | 14 | 7 | 2 | 1 |

| | Number of subjects at risk | | | | | |
|---|---|---|---|---|---|---|
| | 0 | 24 | 48 | 72 | 96 | 120 (mo) |
| Low | 62 | 27 | 10 | 4 | 1 | 1 |
| High | 62 | 27 | 12 | 6 | 4 | 1 |

TARGET PEPTIDES FOR IMMUNOTHERAPY AND DIAGNOSTICS

CROSS REFERENCE TO RELATED APPLICATIONS

The presently disclosed subject matter claims the benefit of U.S. Provisional Patent Application Ser. Nos. 61/695,776, filed Aug. 31, 2012, and 61/696,787, filed Sep. 4, 2012, the disclosure of each of which is incorporated herein by reference in its entirety.

GRANT STATEMENT

This invention was made with government support under Grant Nos. AI033993, AI020963, and CA134060 awarded by National Institutes of Health. The government has certain rights in the invention.

REFERENCE TO SEQUENCE LISTING

The Sequence Listing associated with the instant disclosure has been electronically submitted to the United States Patent and Trademark Office as International Receiving Office as a 782 kilobyte ASCII text file created on Sep. 3, 2013 and entitled "3062_2_PCT_ST25.txt". The Sequence Listing submitted via EFS-Web is hereby incorporated by reference in its entirety.

TECHNICAL FIELD

The presently disclosed subject matter relates to the area of diagnostics and therapeutics. In particular, it relates to immunotherapies and diagnostics in the context of proliferative diseases such as nut not limited to cancer.

BACKGROUND

The mammalian immune system has evolved a variety of mechanisms to protect the host from cancerous cells. An important component of this response is mediated by cells referred to as T cells. Cytotoxic T lymphocytes (CTL) are specialized T cells that primarily function by recognizing and killing cancerous cells or infected cells, but they can also function by secreting soluble molecules referred to as cytokines that can mediate a variety of effects on the immune system. T helper cells primarily function by recognizing antigen on specialized antigen presenting cells, and in turn secreting cytokines that activate B cells, T cells, and macrophages. A variety of evidence suggests that immunotherapy designed to stimulate a tumor-specific CTL response would be effective in controlling cancer. For example, it has been shown that human CTL recognize sarcomas (Slovin et al., 1986), renal cell carcinomas (Schendel et al., 1993), colorectal carcinomas (Jacob et al., 1997), ovarian carcinomas (Peoples et al., 1993), pancreatic carcinomas (Peiper et al., 1997), squamous tumors of the head and neck (Yasumura et al., 1993), and squamous carcinomas of the lung (Slingluff et al., 1994; Yoshino et al., 1994). The largest number of reports of human tumor-reactive CTLs, however, has concerned melanomas (Boon et al., 1994). The ability of tumor-specific CTL to mediate tumor regression, in both human (Parmiani et al., 2002; Weber, 2002) and animal models, suggests that methods directed at increasing CTL activity would likely have a beneficial effect with respect to tumor treatment.

Melanoma, or skin cancer, is a disease that is diagnosed in approximately 54,200 persons per year. Conventional therapy for the disease includes surgery, radiation therapy, and chemotherapy. In spite of these approaches to treatment, approximately 7,600 individuals die in the United States every year due to melanoma. Overall, the 5-year survival rate for the disease is 88%. The survival rate drops, however, in more advanced stages of the disease with only about 50% of Stage III patients and 20-30% of Stage IV patients surviving past five years. In patients where the melanoma has metastasized to distant sites, the 5-year survival dips to only 12%. Clearly, there is a population of melanoma patients that is in need of better treatment options. More recently, in an attempt to decrease the number of deaths attributed to melanoma, immunotherapy has been added to the arsenal of treatments used against the disease.

Dramatic regressions of melanoma have been induced with several types of immune therapies, including high-dose interleukin-2 and anti-CTLA4 antibody, which is FDA approved therapies for advanced melanoma, and adoptive T cell therapy, with reported objective response rates of 17%, 13%, and 51%, respectively, and with complete response (CR) rates in the range of 4-7%. Results with these therapies provide proof-of-principle for the therapeutic potential of immune therapy in melanoma. Unfortunately, the toxicities for all three therapies limit participant eligibility; so less toxic immune therapies with vaccines are being explored as alternative treatment options. This is especially true in the adjuvant setting where the only FDA-approved adjuvant therapy for patients with resected high-risk melanoma is high-dose, systemic interferon alpha. However, the most recent pooled analysis of interferon alpha therapy highlights the questionable survival advantage even of that therapy, for patients in the adjuvant setting. Thus, there is a critical need for additional new therapies for melanoma, both for adjuvant therapy of high-risk resected melanoma and for therapy of patients who are not candidates for, or fail, other therapies in the setting of advanced disease.

In order for CTL to kill or secrete cytokines in response to a cancer cell, the CTL must first recognize the cancer cell (Townsend & Bodmer, 1989). This process involves the interaction of the T cell receptor, located on the surface of the CTL, with what is generically referred to as an MHC-peptide complex which is located on the surface of the cancerous cell. MHC (major histocompatibility-complex)-encoded molecules have been subdivided into two types, and are referred to as class I and class II MHC-encoded molecules. In the human immune system, MHC molecules are referred to as human leukocyte antigens (HLA). Within the MHC complex, located on chromosome six, are three different loci that encode for class I MHC molecules. MHC molecules encoded at these loci are referred to as HLA-A, HLA-B, and HLA-C. The genes that can be encoded at each of these loci are extremely polymorphic, and thus, different individuals within the population express different class I MHC molecules on the surface of their cells. HLA-A1, HLA-A2, HLA-A3, HLA-B7, HLA-B14, HLA-B27, and HLA-B44 are examples of different class I MHC molecules that can be expressed from these loci.

The peptides which associate with the MHC molecules can either be derived from proteins made within the cell, in which case they typically associate with class I MHC molecules (Rock & Goldberg, 1999); or they can be derived from proteins which are acquired from outside of the cell, in which case they typically associate with class II MHC molecules (Watts, 1997). The peptides that evoke a cancer-specific CTL response most typically associate with class I MHC molecules. The peptides themselves are typically nine amino acids in length, but can vary from a minimum length of eight amino acids to a maximum of fourteen amino acids in length. Tumor antigens may also bind to class II MHC molecules on antigen presenting cells and provoke a T helper cell response. The peptides that bind to class II MHC molecules are generally twelve to nineteen amino acids in length, but can be as short as ten amino acids and as long as thirty amino acids.

The process by which intact proteins are degraded into peptides is referred to as antigen processing. Two major pathways of antigen processing occur within cells (Rock & Goldberg, 1999). One pathway, which is largely restricted to professional antigen presenting cells such as dendritic cells, macrophages, and B cells, degrades proteins that are typically phagocytosed or endocytosed into the cell. Peptides derived from this pathway can be presented on either class I or to class II MHC molecules. A second pathway of antigen processing is present in essentially all cells of the body. This second pathway primarily degrades proteins that are made within the cells, and the peptides derived from this pathway primarily bind to class I MHC molecules. Antigen processing by this latter pathway involves polypeptide synthesis and proteolysis in the cytoplasm, followed by transport of peptides to the plasma membrane for presentation. These peptides, initially being transported into the endoplasmic reticulum of the cell, become associated with newly synthesized class I MHC molecules and the resulting complexes are then transported to the cell surface. Peptides derived from membrane and secreted proteins have also been identified. In some cases these peptides correspond to the signal sequence of the proteins which is cleaved from the protein by the signal peptidase. In other cases, it is thought that some fraction of the membrane and secreted proteins are transported from the endoplasmic reticulum into the cytoplasm where processing subsequently occurs. Once bound to the class I MHC molecule, the peptides are recognized by antigen-specific receptors on CTL. Several methods have been developed to identify the peptides recognized by CTL, each method of which relies on the ability of a CTL to recognize and kill only those cells expressing the appropriate class I MHC molecule with the peptide bound to it. Mere expression of the class I MHC molecule is insufficient to trigger the CTL to kill the target cell if the antigenic peptide is not bound to the class I MHC molecule. Such peptides can be derived from a non-self source, such as a pathogen (for example, following the infection of a cell by a bacterium or a virus) or from a self-derived protein within a cell, such as a cancerous cell. The tumor antigens from which the peptides are derived can broadly be categorized as differentiation antigens, cancer/testis antigens, mutated gene products, widely expressed proteins, viral antigens and most recently, phosphopeptides derived from dysregulated signal transduction pathways. (Zarling et al., 2006).

Adoptive T cell therapy of melanoma is described in two recent publications: Dudley et al., 2008 and Rosenberg & Dudley, 2009. For adoptive T cell therapy, late stage metastatic melanoma patients are treated as if they were undergoing an organ transplant operation. Tumor is resected and cytotoxic T cells that have infiltrated the tumor are harvested and exposed to a particular class I peptide antigen (MART-1). Those that recognize this antigen are then allowed to expand until the total number of MART-1 specific cells reach 100 billion. The patient receives whole body irradiation and chemotherapy to wipe out 98% of his/her immune system. The MART specific T cells are then given back to the patient and circulate throughout the body looking for tumor. In the most recent clinical trial, tumors in 72% of the patients showed objective responses with this therapy at all sites of metastasis including lymph nodes, bone, lung, liver, and brain. Twenty-eight percent of the patients had complete remission of the disease.

Immunization with melanoma-derived, class I or class II MHC-encoded molecule associated peptides, or with a precursor polypeptide or protein that contains the peptide, or with a gene that encodes a polypeptide or protein containing the peptide, are forms of immunotherapy that can be employed in the treatment of melanoma. Identification of the immunogens is a necessary first step in the formulation of the appropriate immunotherapeutic agent or agents. Although a large number of tumor-associated peptide antigens recognized by tumor reactive CTL have been identified, there are few examples of antigens that are derived from proteins that are selectively expressed on a broad array of tumors, as well as associated with cellular proliferation and/or transformation.

Attractive candidates for this type of antigen are peptides derived from proteins that are differentially phosphorylated on serine (Ser), threonine (Thr), and tyrosine (Tyr). See Zarling et al., 2000. Due to the increased and dysregulated phosphorylation of cellular proteins in transformed cells as compared to normal cells, tumors are likely to present a unique subset of phosphorylated peptides on the cell surface that are available for recognition by cytotoxic T-lymphocytes (CTL). Presently, there is no way to predict which protein phosphorylation sites in a cell will be unique to tumors, survive the antigen processing pathway, and be presented to the immune system in the context of 8-14 residue phosphopeptides bound to class I MHC molecules.

Thirty-six phosphopeptides were disclosed as presented in association with HLA A*0201 on cancer cells. (see Table 1 of Zarling et al., 2006). Parent proteins for four of these peptides—beta-catenin, insulin receptor substrate-2 (IRS-2), tensin-3, and Jun-C/D—are associated with cytoplasmic signaling pathways and cellular transformation.

While both normal and cancer cells lines express the parent proteins, only the three cancer lines express phosphorylated class I peptide sequences within IRS-2 and beta-catenin, respectively. Mice expressing a transgenic recombinant human A*0201 MHC molecule were immunized with a synthetic class I phosphopeptides from IRS-2 and beta-catenin that were pulsed onto activated bone-marrow derived dendritic cells. Cytotoxic T cells were generated that recognized all three cancer cell lines but not the control JY cell line (i.e., an Epstein-Barr virus transformed B lymphoblastoid cell line).

β-catenin, a protein involved in cell adhesion and a downstream mediator of Wnt signaling, has been implicated in tumor development and progression (Takemaru et al., 2008). An HLA-A*0201-restricted phosphorylated peptide derived from β-catenin and (residues 30-39) that is presented by melanoma cell lines was described by (Zarling et al., 2006). Mutations in this region of β-catenin or in "destruction complex" proteins diminish phosphorylation and degradation of β-catenin and thereby stabilize the protein (Yost et al., 1996). Once stabilized, β-catenin translocates into the nucleus by an unknown mechanism where it associates with TCF/Lef proteins to activate transcription of genes such as cyclin D1 (Tetsu & McCormick, 1999), c-myc (He et al., 1998), and metalloproteases (Crawford et al., 1999; Takahashi et al., 2002), which promote tumorigenesis and metastasis.

While mutations in β-catenin or the destruction complex proteins are involved in the development of gastrointestinal cancers (Morin et al., 1997; Ogasawara et al., 2006), they are rarely found in human melanoma samples (Rimm et al., 1999; Omholt et al., 2001; Worm et al., 2004) and cell lines (Pollock & Hayward, 2002; Worm et al., 2004). Additionally, the expression of β-catenin in melanoma cells diminishes with disease progression (Sanders et al., 1999; Kageshita et al., 2001; Maelandsmo et al., 2003; Krengel et al., 2004; Hoek et al., 2006; Pecina-Slaus et al., 2007). Despite the reduced expression, nuclear β-catenin has been observed in melanoma samples and may be transcriptionally active in promoting invasive behavior of melanoma cells (Rimm et al., 1999; Bachmann et al., 2005; Chien et al., 2009; Arozarena et al., 2011).

Degradation of β-catenin is dependent on phosphorylation of the protein at S33, S37, and T41 by GSK-3β (Kimelman & Xu, 2006). Thus detection of this phosphorylated form of the protein in cells indicates that β-catenin has been marked for degradation. Phosphorylated β-catenin has been detected in metastatic melanomas and to a lesser extent, primary melanomas (Kielhorn et al., 2003) but the relative abundances of the different forms of phosphorylated β-catenin (S33/S37/T41, S37/T41, S33/S37, T41, S37, or S33 only) were not distinguished.

Until the present disclosure, no studies have examined MHC class-I-bound phosphopeptide displayed on primary human tumor samples, and there is only limited evidence of a human immune response against class-I restricted phosphopeptides.

SUMMARY

This Summary lists several embodiments of the presently disclosed subject matter, and in many cases lists variations and permutations of these embodiments. This Summary is merely exemplary of the numerous and varied embodiments. Mention of one or more representative features of a given embodiment is likewise exemplary. Such an embodiment can typically exist with or without the feature(s) mentioned; likewise, those features can be applied to other embodiments of the presently disclosed subject matter, whether listed in this Summary or not. To avoid excessive repetition, this Summary does not list or suggest all possible combinations of such features.

In some embodiments, the presently disclosed subject matter provides an isolated and purified target peptide that consists of between 8 and 50 contiguous amino acid residues derived from a native human protein. In some embodiments, the target peptide is a peptide that comprises a sequence selected from SEQ ID NO: 1-2167 and 2374. In some embodiments, the target peptide is a phosphopeptide that comprises a sequence selected from SEQ ID NO: 1-2163 in which at least one serine, threonine, or tyrosine residue in the selected sequence is phosphorylated with a hydrolyzable or non-hydrolyzable phosphate group. In some embodiments, the peptide is an comprises an O-GlcNAcylated peptide that comprises an amino acid sequence selected from SEQ ID NOs: 2163-2167 and 2374. In some embodiments, contiguous amino acids adjacent to the selected sequence in the phosphopeptide are selected from the adjacent residues in the native human protein. In some embodiments, when the sequence is selected from SEQ ID NO: 393-465, the phosphopeptide is phosphorylated with a non-hydrolyzable phosphate group.

The presently disclosed subject matter also provides in some embodiments methods for immunizing a mammal to diminish the risk of, the growth of, or the invasiveness of a melanoma. In some embodiments, a composition is administered to the mammal that activates $CD8^+$ T cells. In some embodiments, the composition comprises a phosphopeptide that consists of between 8 and 50 contiguous amino acid residues derived from a native human protein. In some embodiments, the target peptide is a peptide that comprises a sequence selected from SEQ ID NO: 1-2167 and 2374. In some embodiments, the target peptide is a phosphopeptide that comprises a sequence selected from SEQ ID NO: 1-2163 in which at least one serine, threonine, or tyrosine residue in the selected sequence is phosphorylated with a hydrolyzable or non-hydrolyzable phosphate group. In some embodiments, the peptide is an comprises an O-GlcNAcylated peptide that comprises an amino acid sequence selected from SEQ ID NOs: 2163-2167 and 2374. In some embodiments, contiguous amino acids adjacent to the selected sequence in the phosphopeptide are selected from the adjacent residues in the native human protein. In some embodiments, when the sequence is selected from SEQ ID NO: 393-465, the phosphopeptide is phosphorylated with a non-hydrolyzable phosphate group.

The presently disclosed subject matter also provides in some embodiments methods that can be used for monitoring, diagnosis, or prognosis. In some embodiments, a sample isolated from a patient is contacted with an antibody that specifically binds to a phosphopeptide. In some embodiments, the phosphopeptide consists of between 8 and 50 contiguous amino acid residues derived from a native human protein. In some embodiments, the target peptide is a peptide that comprises a sequence selected from SEQ ID NO: 1-2167 and 2374. In some embodiments, the target peptide is a phosphopeptide that comprises a sequence selected from SEQ ID NO: 1-2163 in which at least one serine, threonine, or tyrosine residue in the selected sequence is phosphorylated with a hydrolyzable or non-hydrolyzable phosphate group. In some embodiments, the peptide is an comprises an O-GlcNAcylated peptide that comprises an amino acid sequence selected from SEQ ID NOs: 2163-2167 and 2374. In some embodiments, contiguous amino acids adjacent to the selected sequence in the phosphopeptide are selected from the adjacent residues in the native human protein. In some embodiments, the antibody does not bind to a peptide consisting of the same amino acid sequence but devoid of phosphorylation. In some embodiments, antibody bound to the sample is measured or detected.

The presently disclosed subject matter also provides in some embodiments molecules that comprise an antigen-binding region of an antibody. In some embodiments, the molecule specifically binds to a phosphopeptide and does not bind to a peptide consisting of the same amino acid sequence but devoid of phosphorylation. In some embodiments, the phosphopeptide consists of between 8 and 50 contiguous amino acid residues derived from a native human protein. In some embodiments, the target peptide is a peptide that comprises a sequence selected from SEQ ID NO: 1-2167 and 2374. In some embodiments, the target peptide is a phosphopeptide that comprises a sequence selected from SEQ ID NO: 1-2163 in which at least one serine, threonine, or tyrosine residue in the selected sequence is phosphorylated with a hydrolyzable or non-hydrolyzable phosphate group. In some embodiments, the peptide is an comprises an O-GlcNAcylated peptide that comprises an amino acid sequence selected from SEQ ID NOs: 2163-2167 and 2374. In some embodiments, contiguous amino acids adjacent to the selected sequence in the phosphopeptide are selected from the adjacent residues in the native human protein.

The presently disclosed subject matter also provides in some embodiments kits for measuring a phosphoprotein that in some embodiments consists of between 8 and 50 contiguous amino acids. In some embodiments, the phosphoprotein comprises a sequence selected from SEQ ID NO: 1-2163 that includes a phosphorylated serine, threonine, or tyrosine residue. In some embodiments, the kit comprises a molecule comprising an antigen-binding region of an antibody, wherein the molecule specifically binds to the phosphoprotein and does not bind to a protein consisting of the same amino acid sequence but devoid of phosphorylation.

The presently disclosed subject matter also provides in some embodiments methods that are useful for producing an immunotherapeutic agent or tool. In some embodiments of the presently disclosed methods, dendritic cells are contacted in vitro with an isolated phosphopeptide consisting of between 8 and 50 contiguous amino acids. In some embodiments, the target peptide is a peptide that comprises a sequence selected from SEQ ID NO: 1-2167 and 2374. In some embodiments, the target peptide is a phosphopeptide that comprises a sequence selected from SEQ ID NO: 1-2163 in which at least one serine, threonine, or tyrosine residue in the selected sequence is phosphorylated with a hydrolyzable or non-hydrolyzable phosphate group. In some embodiments, the peptide is an comprises an O-GlcNAcylated peptide that comprises an amino acid sequence selected from SEQ ID NOs: 2163-2167 and 2374. In some embodiments, the dendritic cells thereby become phosphopeptide-loaded. In some embodiments, when the sequence is selected from SEQ ID NO: 393-465, the phosphopeptide is phosphorylated with a non-hydrolyzable phosphate group. In some embodiments, the dendritic cells made by the presently disclosed methods provide in vitro compositions of dendritic cells, which in some embodiments are useful as immunotherapeutic agents.

The presently disclosed subject matter also provides in some embodiments synthetic phosphopeptides. In some embodiments, the synthetic phosphopeptides comprise from 10-50 amino acid residues. In some embodiments, the synthetic phosphopeptides comprise the amino acid sequence RVAsPTSGVK (SEQ ID NO: 65) or the amino acid sequence RVAsPTSGVKR (SEQ ID NO: 66), wherein in some embodiments the serine residue at position 4 is phosphorylated with a hydrolyzable or nonhydrolyzable phosphate group, and wherein in some embodiments adjacent amino acid residues to the sequence are adjacent sequences in the human insulin substrate-2 (IRS-2) protein. In some embodiments, the phosphopeptide is useful for loading dendritic cells so that they present phosphopeptide on HLA-A*0301 molecules.

The presently disclosed subject matter also provides in some embodiments isolated and purified phosphopeptides. In some embodiments, the isolated and purified phosphopeptides consist of between 8 and 50 contiguous amino acid residues derived from a native human protein. In some embodiments, the isolated nad purified phosphopeptides comprise a sequence selected from SEQ ID NO:1-2163, wherein at least one serine, threonine, or tyrosine residue in the selected sequence is phosphorylated with a hydrolyzable or non-hydrolyzable phosphate group, wherein in some embodiments the contiguous amino acids adjacent to the selected sequence in the phosphopeptide are the adjacent contiguous amino acid residues in the native human protein. In some embodiments, the phosphopeptides are substantially free of other peptides.

The presently disclosed subject matter also provides in some embodiments compositions comprising the target peptides that are in some embodiments substantially free of human cells. In some embodiments, the compositions comprise an admixture with one or more distinct peptides. In some embodiments, the composition comprises melanoma-specific peptides or leukemia-specific peptides. In some embodiments, the composition comprises an immune adjuvant. In some embodiments, the composition is an admixture of target peptides, wherein a least one target peptide that binds to each of an HLA-A*0101, HLA-A*0301, HLA-B*4402, HLA-B*2705, and HLA-B*0702 molecule is present in the admixture. In some embodiments, the composition comprises at least one target peptide that binds to HLA-A*0201.

The presently disclosed subject matter also provides in some embodiments compositions comprising a target peptide as disclosed herein in a complex with an HLA-A*0101, HLA-A*0301, HLA-B*4402, HLA-B*2705, HLA-B*1402, or HLA-B*0702 molecule. In some embodiments, the complex is a tetramer.

The presently disclosed subject matter also provides in some embodiments methods for immunizing a mammal to diminish the risk of, the growth of, or the invasiveness of a proliferative disease such as cancer. In some embodiments, the presently disclosed methods comprise administering to the mammal a target peptide composition, whereby $CD8^+$ T cells are activated be the phosphopeptide. In some embodiments, the phosphopeptide comprises at least 15 amino acid residues. In some embodiments, the presently disclosed methods further comprise administering TLR-ligand oligonucleotide-CpG. In some embodiments, at least two target peptides are administered that share a sequence of at least 6 amino acid residues. In some embodiments, the mammal is a transgenic non-human comprising a human HLA. In some embodiments, the mammal is a dog, cat, horse, or mouse. In some embodiments, the mammal has a melanoma. In some embodiments, the mammal has metastatic melanoma. In some embodiments, the mammal has an increased risk of developing a melanoma.

The presently disclosed subject matter also provides in some embodiments methods for contacting a sample isolated from a patient with an antibody that specifically binds to the target peptide and does not bind to a peptide consisting of the same amino acid sequence but devoid of phosphorylation/O-GlcNAC moieties and measuring or detecting antibody bound to the sample. In some embodiments, the sample is tissue, blood, serum, plasma, lymph, urine, saliva, mucus, stool, or skin. In some embodiments, the sample is a biopsy sample from tumor or normal tissue. In some embodiments, the sample is from a lymph node.

The presently disclosed subject matter also provides in some embodiments molecules comprising an antigen-binding region of an antibody, wherein the molecule specifically binds to the target peptide and does not bind to a peptide consisting of the same amino acid sequence but devoid of phosphorylation and/or O-GlcNAC moieties. In some embodiments, the antibody is a monoclonal antibody. In some embodiments, the molecule is a single chain variable region (ScFv).

The presently disclosed subject matter also provides in some embodiments kits for measuring a phosphoprotein, said phosphoprotein comprising a sequence selected from SEQ ID NO:1-2163 and including a phosphorylated serine, threonine, or tyrosine residue. In some embodiments, the presently disclosed kits comprise a molecule comprising an antigen-binding region of an antibody, wherein the molecule specifically binds to the target peptide and does not bind to a protein consisting of the same amino acid sequence but devoid of a phosphorylation/O-GlcNAC moiety. In some embodiments, the kit comprises an antibody that specifically binds to a portion of the molecule that is distinct from the antigen-binding region. In some embodiments, the kit further comprises a detectable label. In some embodiments, the kit further comprises a solid support on which binding complexes of the molecule and the target peptides can be captured.

The presently disclosed subject matter also provides in some embodiments methods comprising contacting dendritic cells in vitro with an isolated phosphopeptide comprising between 8 and 50 contiguous amino acids comprising a sequence selected from SEQ ID NO: 1-2163, said phosphopeptide including at least one serine, threonine, or tyrosine residue that is phosphorylated, whereby the dendritic cells become phosphopeptide-loaded.

In some embodiments, the methods involve transfusing or injecting the phosphopeptide-loaded dendritic cells into a cancer patient, optionally a leukemia patient, wherein the sequence is selected from the group consisting of SEQ ID NO: 267, 269-270, 272-274, 276, 282-289, 291-298, 302-308, 310, 312-325, 327-328, 330-331, 333-334, 336-340, 342-352, 356, 358-361, 363, 366-368, 370-371, 374-375, 377-379, 382-383, 385-389, 391-392, 1529-1534, 1539-1544, 1549-1570, 1576-1578, 1594-1617, 1622-1627, 1634-1646, 1656-1680, 1684-1687, 1691-1735, 1739-1744, 1748-1754, 1758-1763, 1767-1784, 1788-1826, 1836-1842, 1846-1874, 1878-1885, 1892-1905, 1909-1915, 1922-1927, 1932-1940, 1947-1952, 1956-1971, 1975-1988. In some embodiments, the phosphopeptide-loaded dendritic cells with CD8+ T cells in vitro, whereby the CD8+ T cells are stimulated. In some embodiments, the methods involve transfusing the stimulated CD8+ T cells into a melanoma or leukemia patient. In some embodiments, the CD8+ T cells are autologous to the patient. In some embodiments, the CD8+ T cells are allogeneic to the patient. In some embodiments, the dendritic cells are contacted with a plurality of said isolated phosphopeptides. In some embodiments, the dendritic cells are contacted with a plurality of said isolated phosphopeptides which are linked by a spacer of 10-50 amino acid residues.

In some embodiments, the presently disclosed subject matter also provides in vitro compositions comprising dendritic cells. In some embodiments, the dendritic cells are loaded with a phosphopeptide consisting of between 8 and 14 contiguous amino acids comprising a sequence selected from SEQ ID NO: 1-2163, said phosphopeptide including at least one serine, threonine, or tyrosine residue that is phosphorylated. In some embodiments, the phosphopeptide comprises at least one amino acid residue that is not in its native human protein. In a further embodiment, the at least one amino acid residue is an optimal anchor residue for its corresponding HLA molecule. In some embodiments, the phosphopeptide is phosphorylated with a non-hydrolyzable phosphate group, which in some embodiments is a —$CF_2$—$PO_3H$ group. In some embodiments, the phosphopeptide is phosphorylated with a non-hydrolyzable phosphate group that in some embodiments is a —$CH_2$—$PO_3H$ group.

The presently disclosed subject matter also provides in some embodiments synthetic phosphopeptides consisting of from 10-50 amino acid residues, comprising the sequence RVAsPTSGVK (SEQ ID NO: 65) or RVAsPTSGVKR (SEQ ID NO: 66), wherein the serine residue at position 4 is phosphorylated with a hydrolyzable or non-hydrolyzable phosphate group, and wherein adjacent amino acid residues to the sequence are adjacent sequences in human insulin substrate-2 (IRS-2) protein. In some embodiments, the composition comprises the synthetic phosphopeptide in a complex with A*0301.

The presently disclosed subject matter also provides in some embodiments concatamers of at least two phosphopeptides that are linked by a spacer of 10-50 amino acid residues.

The presently disclosed subject matter also provides in some embodiments compositions comprising at least three synthetic peptides which are exactly, about, or at least 8, 9, 10, 11, 12, 13, 14, or 15 or more amino acids long. In some embodiments, the first peptide comprises a sequence selected from the group consisting of selected from a group consisting of SEQ ID NO: 398, SEQ ID NO: 2000, SEQ ID NO: 2001, and SEQ ID NO: 2002 (BCAR3). In some embodiments, the second peptide comprises a sequence selected from the group consisting of SEQ ID NO: 427, SEQ ID NO: 2078, SEQ ID NO: 2079, SEQ ID NO: 2080, SEQ ID NO: 2081, SEQ ID NO: 2082, SEQ ID NO: 2083, and SEQ ID NO: 2084 (beta-catenin). In some embodiments, the third peptide comprises a sequence selected from the group consisting of SEQ ID NO: 418, SEQ ID NO: 2062, and SEQ ID NO: 2063 (IRS-2) wherein said composition has the ability to stimulate an immune response to said first second or third peptides. In some embodiments, the first peptide is SEQ ID NO: 398. In some embodiments, the second peptide is SEQ ID NO: 2080. In some embodiments, the third peptide is SEQ ID NO: 418. In some embodiments, at least one serine residue in any of the peptides is replaced with a homo-serine. In some embodiments, the composition comprises a non-hydrolyzable phosphate. In some embodiments, at least one of the peptides binds MHC class I at least 500% more tightly than its native counterpart. In some embodiments, at least one of the peptides is capable of eliciting more activated CD8+ T cells specific for MHC class I molecule complexed with the phosphopeptide of SEQ ID NO: 427 than a control composition comprising the same peptides except SEQ ID NO: 427 rather than SEQ ID NO: 2080. In some embodiments, the compositions are at least 100% more immunogenic than a control composition comprising the same peptides except SEQ ID NO: 427 rather than SEQ ID NO: 2080. In some embodiments, the compositions are capable of reducing tumor size in a NOD/SCID/IL-2R$\gamma c^{-/-}$ mouse by at least 30% compared to a control composition comprising the same peptides except SEQ ID NO: 427 rather than SEQ ID NO: 2080. In some embodiments, the compositions are immunologically suitable for at least 60% to 88% of melanoma patients. In some embodiments, the compositions comprise at least 5, 10, or 15 different peptides. In some embodiments, the compositions comprise a peptide capable of binding to an MHC class I molecule selected from the group consisting of HLA-A*0201, HLA-A*0101, HLA-A*0301, HLA-B*4402, HLA-B*0702, HLA-B*-2705, and HLA-B*1402. In some embodiments, the compositions comprise a peptide capable of binding to an MHC class I molecule selected from the group consisting of HLA-A*0101, HLA-A*0301, HLA-B*4402, HLA-B*0702, HLA-B*-2705, and HLA-B*1402. In some embodiments, the compositions comprise a peptide capable of binding to an HLA-A*0101 or an HLA-B*0702 MHC class I molecule.

In some embodiments, the compositions are capable of increasing the 5-year survival rate of malignant melanoma patients treated with the composition by at least 20 percent relative to average 5-year survival rates that could have been expected without treatment with the composition. In some embodiments, the compositions are capable of increasing the survival rate of malignant melanoma patients treated with the composition by at least 20 percent relative to a survival rate that could have been expected without treatment with the composition. In some embodiments, the compositions are capable of increasing the treatment response rate of malignant melanoma patients treated with the composition by at least 20 percent relative to a treatment rate that could have been expected without treatment with the composition. In some embodiments, the compositions are capable of increasing the overall median survival of patients of malignant melanoma patients treated with the composition by at least two months relative to an overall median survival that could have been expected without treatment with the composition.

In some embodiments, the compositions comprise at least one peptide derived from a MelanA (MART-I) polypeptide, a gp100 (Pmel 17) polypeptide, a tyrosinase polypeptide, a TRP-1 polypeptide, a TRP-2 polypeptide, a MAGE-1 polypeptide, a MAGE-3 polypeptide, a BAGE polypeptide, a GAGE-1 polypeptide, a GAGE-2 polypeptide, a p15(58) polypeptide, a CEA polypeptide, a RAGE polypeptide, an NY-ESO (LAGE) polypeptide, an SCP-1 polypeptide, a Hom/Mel-40 polypeptide, a PRAME polypeptide, a p53 polypeptide, an H-Ras polypeptide, a HER-2/neu polypeptide, a BCR-ABL polypeptide, an E2A-PRL polypeptide, an H4-RET polypeptide, an IGH-IGK polypeptide, an MYL-RAR polypeptide, an Epstein Barr virus antigen polypeptide, an EBNA polypeptide, a human papillomavirus (HPV) antigen E6 and/or E7 polypeptide, a TSP-180 polypeptide, a MAGE-4 polypeptide, a MAGE-5 polypeptide, a MAGE-6 polypeptide, a p185erbB2 polypeptide, a p180erbB-3 polypeptide, a c-met polypeptide, an nm-23H1 polypeptide, a PSA polypeptide, a TAG-72-4 polypeptide, a CA 19-9 polypeptide, a CA 72-4 polypeptide, a CAM 17.1 polypeptide, a NuMa polypeptide, a K-ras polypeptide, a β-Catenin polypeptide, a CDK4 polypeptide, a Mum-1 polypeptide, a p16 polypeptide, a TAGE polypeptide, a PSMA polypeptide, a PSCA polypeptide, a CT7 polypeptide, a telomerase polypeptide, a 43-9F polypeptide, a 5T4 polypeptide, a 791Tgp72 polypeptide, an α-fetoprotein polypeptide, a β-HCG polypeptide, a BCA225 polypeptide, a BTAA polypeptide, a CA 125 polypeptide, a CA 15-3 (CA 27.29\BCAA) polypeptide, a CA 195 polypeptide, a CA 242 polypeptide, a CA-50 polypeptide, a CAM43 polypeptide, a CD68\KP1 polypeptide, a CO-029 polypeptide, an FGF-5 polypeptide, a G250 polypeptide, a Ga733 (EpCAM) polypeptide, an HTgp-175 polypeptide, an M344 polypeptide, an MA-50 polypeptide, an MG7-Ag polypeptide, a MOV18 polypeptide, an NB/70K polypeptide, an NY-CO-1 polypeptide, a RCAS1 polypeptide, an SDCCAG16 polypeptide, a TA-90 (Mac-2 binding protein\cyclophilin C-associated protein) polypeptide, a TAAL6 polypeptide, a TAG72 polypeptide, a TLP polypeptide, and a TPS polypeptide.

In some embodiments, the compositions comprise an agent selected from the group consisting of a CTLA-4 antagonist, vermurafenib, ipilimumab, dacarbazine, IL-2, temozolomide, imatinib, gefitinib, erlotinib, sunitinib, tyrphostins and telatinib. In some embodiments, the compositions comprise dacarbazine, carmustine and tamoxifen. In some embodiments, the compositions comprise an adjuvant selected from the group consisting of montanide ISA-51 (Seppic, Inc., Fairfield, N.J., United States of America), QS-21 (Aquila Biopharmaceuticals, Inc., Lexington, Mass., United States of America), tetanus helper peptides, GM-CSF, cyclophosamide, bacillus Calmette-Guerin (BCG), corynbacterium parvum, levamisole, azimezone, isoprinisone, dinitrochlorobenezene (DNCB), keyhole limpet hemocyanins (KLH), Freunds adjuvant (complete and incomplete), mineral gels, aluminum hydroxide (Alum), lysolecithin, pluronic polyols, polyanions, peptides, oil emulsions, dinitrophenol, diphtheria toxin (DT).

In some embodiments, the presently disclosed subject matter also provides compositions for treating a proliferative disease. In some embodiments, the compositions comprise (i) a tetanus peptide comprising a sequence selected from the group consisting of SEQ ID NOs. 2376 and 2377; and (ii) at least or about 1, 2, 3, 4, or 5 synthetic target peptides, each of which is at least or about 8, 9, 10, 11, 12, 13, 14, or 15 amino acids long. In some embodiments, the at least or about 1, 2, 3, 4, or 5 synthetic target peptide(s) is/are selected from the group consisting of (A) a first target peptide comprising a sequence selected from the group consisting of SEQ ID NO: 398, SEQ ID NO: 2000, SEQ ID NO: 2001, and SEQ ID NO: 2002; (B) a second target peptide comprising a sequence selected from the group consisting of SEQ ID NO: 418, SEQ ID NO: 2062, and SEQ ID NO: 2063; (C) a third target peptide comprising a sequence selected from the group consisting of SEQ ID NO: 427; SEQ ID NO: 2078, SEQ ID NO: 2079, SEQ ID NO: 2080, SEQ ID NO: 2081, SEQ ID NO: 2082, SEQ ID NO: 2083, and SEQ ID NO: 2084; (D) a fourth target peptide selected from the group consisting of SEQ ID NO: 396; and SEQ ID NO: 1996; and (E) a fifth target peptide from the group consisting of (SEQ ID NO: 426) and (SEQ ID NO: 2077), wherein the composition has the ability to stimulate a T cell-mediated immune response to the at least or about 1, 2, 3, 4, or 5 synthetic target peptide(s); and further wherein the composition is capable of eliciting a memory T cell response to the at least or about 1, 2, 3, 4, or 5 synthetic target peptide(s). In some embodiments, the first target peptide is SEQ ID NO: 398. In some embodiments, the second target peptide is SEQ ID NO: 2080. In some embodiments, the third target peptide is SEQ ID NO: 418. In some embodiments, at least one serine residue in any of the target peptides is replaced with a homoserine.

In some embodiments, the composition for treating a proliferative disease comprises a non-hydrolyzable phosphate.

In some embodiments of the composition for treating a proliferative disease, at least one of the target peptides binds a MHC class I molecule at least 500% more tightly than its native counterpart.

In some embodiments of the composition for treating a proliferative disease, at least one of the target peptides is capable of eliciting more activated $CD8^+$ T cells specific for MHC class I molecule complexed with the phosphopeptide of SEQ ID NO: 427 than a control composition comprising the same target peptide(s) but wherein SEQ ID NO: 427 is present rather than SEQ ID NO: 2080. In some embodiments, the composition is at least 100% more immunogenic than a control composition comprising the same target peptide(s) but wherein SEQ ID NO: 427 is present in the composition rather than SEQ ID NO: 2080. In some embodiments, the composition is capable of reducing tumor size in a NOD/SCID/IL-2Rγc$^{-/-}$ mouse comprising transgenic T cells specific for human β-catenin phosphopeptides such as SEQ ID NO: 427, by at least 30% compared to a control composition comprising the same peptides wherein SEQ ID NO: 427 is present in the composition rather than SEQ ID NO: 2080. In some embodiments, the composition is immunologically suitable for at least 60 to 88% of melanoma patients.

In some embodiments, the composition for treating a proliferative disease comprises at least 5 different target peptides. In some embodiments, the composition for treating a proliferative disease comprises at least 10 different target peptides. In some embodiments, the composition for treating a proliferative disease comprises at least 15 different target peptides.

In some embodiments, the composition for treating a proliferative disease comprises a target peptide capable of binding to an MHC class I molecule selected from the group consisting of HLA-A*0201, HLA-A*0101, HLA-A*0301, HLA-B*4402, HLA-B*0702, HLA-B*-2705 and HLA-B*1402. In some embodiments, the composition for treating a proliferative disease comprises a target peptide capable of binding to an MHC class I molecule selected from the group consisting of HLA-A*0101, HLA-A*0301, HLA-B*4402, HLA-B*0702, HLA-B*-2705 and HLA-B*1402. In some embodiments, the composition for treating a proliferative disease comprises a target peptide capable of binding to an MHC class I molecule of the HLA-A*0201, HLA-A*0101 or HLA-B*0702 alleles.

In some embodiments, the composition for treating a proliferative disease is capable of increasing the 5-year survival rate of malignant melanoma patients treated with the composition by at least 20 percent relative to average 5-year survival rates that could have been expected without treatment with the composition. In some embodiments, the composition for treating a proliferative disease the composition is capable of increasing the survival rate of malignant melanoma patients treated with the composition by at least 20 percent relative to a survival rate that could have been expected without treatment with the composition. In some embodiments, the composition for treating a proliferative disease is capable of increasing the treatment response rate of malignant melanoma patients treated with the composition by at least 20 percent relative to a treatment rate that could have been expected without treatment with the composition. In some embodiments, the composition for treating a proliferative disease is capable of increasing the overall median survival of patients of malignant melanoma patients treated with the composition by at least two months relative to an overall median survival that could have been expected without treatment with the composition.

In some embodiments, the composition for treating a proliferative disease comprises at least one peptide derived from MelanA (MART-I), gp100 (Pmel 17), tyrosinase, TRP-1, TRP-2, MAGE-1, MAGE-3, BAGE, GAGE-1, GAGE-2, p15(58), CEA, RAGE, NY-ESO (LAGE), SCP-1, Hom/Mel-40, PRAME, p53, H-Ras, HER-2/neu, BCR-ABL, E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, β-Catenin, CDK4, Mum-1, p16, TAGE, PSMA, PSCA, CT7, telomerase, 43-9F, 5T4, 791Tgp72, alpha-fetoprotein, β-HCG, BCA225, BTAA, CA 125, CA 15-3 (CA 27.29\BCAA), CA 195, CA 242, CA-50, CAM43, CD68\KP1, CO-029, FGF-5, G250, Ga733 (EpCAM), HTgp-175, M344, MA-50, MG7-Ag, MOV18, NB/70K, NY-CO-1, RCAS1, SDCCAG16, TA-90 (Mac-2 binding protein\cyclophilin C-associated protein), TAAL6, TAG72, TLP and TPS. In some embodiments, the composition for treating a proliferative disease comprises an agent selected from the group consisting of a CTLA-4 antagonist, vemurafenib, ipilimumab, dacarbazine, IL-2, temozolomide, imatinib, gefitinib, erlotinib, sunitinib, tyrphostins, a PD-1 agonist and telatinib. In some embodiments, the composition for treating a proliferative disease further comprises darcarbazine, carmustine and tamoxifen.

In some embodiments, the composition for treating a proliferative disease comprises an adjuvant selected from the group consisting of montanide ISA-51 (Seppic, Inc.), QS-21 (Aquila Pharmaceuticals, Inc.), GM-CSF, cyclophosamide, *bacillus* Calmette-Guerin (BCG), *corynbacterium parvum*, levamisole, azimezone, isoprinisone, dinitrochlorobenezene (DNCB), keyhole limpet hemocyanins (KLH), Freunds adjuvant (complete and incomplete), mineral gels, aluminum hydroxide (Alum), lysolecithin, pluronic polyols, polyanions, peptides, oil emulsions, dinitrophenol, diphtheria toxin (DT).

The presently disclosed subject matter also provides in some embodiments in vitro populations of dendritic cells comprising at least one of the aforementioned target peptide compositions.

The presently disclosed subject matter also provides in some embodiments in vitro populations of $CD8^+$ T cells capable of being activated upon being brought into contact with a population of dendritic cells, wherein the dendritic cells comprise at least one of the aforementioned target peptide compositions.

The presently disclosed subject matter also provides in some embodiments an antibody or antibody-like molecule that specifically binds to any of the target peptides disclosed herein. In some embodiments, the presently disclosed antibody or antibody-like molecule specifically binds to both a first complex of MHC class I molecule and a peptide represented by SEQ ID NO: 2080 and a second complex of MHC class I molecule and a peptide represented by SEQ ID NO: 427; wherein the antibody or antibody-like molecule does not bind the same complexes containing an unphosphorylated version of SEQ ID NO: 2080 or SEQ ID NO: 427. In some embodiments, the antibody or antibody-like molecule is a member of the immunoglobulin superfamily. In some embodiments, the antibody or antibody-like molecule comprises a binding member selected from the group consisting an Fab, Fab', $F(ab')_2$, Fv, and a single-chain antibody. In some embodiments, the antibody or antibody-like molecule comprises a therapeutic agent selected from the group consisting of an alkylating agent, an antimetabolite, a mitotic inhibitor, a taxoid, a vinca alkaloid and an antibiotic. In some embodiments, the antibody or antibody-like molecule is a T cell receptor, optionally linked to a CD3 agonist.

The presently disclosed subject matter also provides in some embodiments an in vitro population of T cells transfected with mRNA encoding a T cell receptor that specifically binds to any of the target peptides disclosed herein.

The presently disclosed subject matter also provides in some embodiments antibodies or antibody-like molecules that specifically bind to both a first complex of MHC class I molecule and a peptide represented by SEQ ID NO: 2080 and a second complex of MHC class I molecule and a peptide represented by SEQ ID NO: 427. In some embodiments, the antibodies or antibody-like molecules do not bind the same complexes containing an unphosphorylated version of SEQ ID NO: 2080 or SEQ ID NO: 427. In some embodiments, the antibodies or antibody-like molecules are members of the immunoglobulin superfamily. In some embodiments, the antibodies or antibody-like molecules comprise a binding member selected from the group consisting of an Fab, Fab', $F(ab')_2$, Fv, and a single-chain antibody. In some embodiments the antibodies or antibody-like molecules comprise a therapeutic agent selected from the group consisting of an alkylating agent, an antimetabolite, a mitotic inhibitor, a taxoid, a vinca alkaloid and an antibiotic. In some embodiments, the antibodies or antibody-like molecules are T cell receptors.

The presently disclosed subject matter also provides in some embodiments in vitro populations of T cells comprising a recombinant nucleic acid encoding the presently disclosed T cell receptors such that recombinant TCRs are expressed on their surfaces.

The presently disclosed subject matter also provides in some embodiments methods for treating and/or preventing cancer, such as but not limited to melanoma or leukemia. In some embodiments, the presently disclosed methods comprise administering to a patient in need thereof a dose of the aforementioned target peptide compositions in combination with a pharmaceutically acceptable carrier.

The presently disclosed subject matter also provides in some embodiments methods for treating and/or preventing cancer. In some embodiments, the presently disclosed methods comprise administering to a patient in need thereof a dose of the aforementioned activated CD8$^+$ T cells in combination with a pharmaceutically acceptable carrier.

The presently disclosed subject matter also provides in some embodiments methods for treating and/or preventing cancer comprising administering to a patient in need thereof a dose of the aforementioned population of the dendritic cells in combination with a pharmaceutically acceptable carrier.

The presently disclosed subject matter also provides in some embodiments methods for of treating and/or preventing cancer comprising administering to a patient in need thereof the population T cells transfected with mRNA encoding a TCR that specifically binds to any of the target peptides disclosed herein in combination with a pharmaceutically acceptable carrier. In some embodiments, the TCR is optionally linked to a CD3 agonist.

The presently disclosed subject matter also provides in some embodiments an in vitro population of T cells transfected with mRNA encoding a T cell receptor that specifically binds to any of the target peptides disclosed herein The presently disclosed subject matter also provides in some embodiments methods for making a cancer vaccine. In some embodiments, the presently disclosed methods comprise combining the target peptide compositions with a chemotherapeutic agent, an adjuvant, a pharmaceutically acceptable carrier; and placing the composition, adjuvant and pharmaceutical carrier into a syringe into a syringe.

The presently disclosed subject matter also provides in some embodiments, methods for screening target peptides for inclusion in an immunotherapy. In some embodiments, the presently disclosed methods comprise (a) contacting a target peptide with a population of human T cells; (b) determining whether the target peptide is capable of inducing a target peptide-specific memory T cell response in a portion of the population of human T cells; and (c) selecting the target peptide for inclusion in the immunotherapy composition if the target peptide elicits a memory T cell response in the portion.

The presently disclosed subject matter also provides methods for determining the prognosis of a cancer patient. In some embodiments, the presently disclosed methods comprise (a) contacting a target peptide with a population of human T cells obtained from the patient; (b) determining whether the target peptide is capable of inducing a target peptide-specific memory T cell response in a portion of the population; and (c) determining that the cancer patient has a better prognosis if the portion mounts a memory T cell response to said target peptide than if the portion did not mount a memory T cell response to said target peptide.

In some embodiments, the presently disclosed subject matter also provides methods for inducing a target peptide specific memory T cell response in a patient having a proliferative disorder. In some embodiments, the presently disclosed subject matter methods comprise (a) administering to a patient in need thereof a composition comprising at least one target peptide and an adjuvant; and (b) inducing the memory T cell response to the at least one target peptide wherein the memory T cell response is capable of treating the disorder. In some embodiments, the at least one target peptide comprises (i) a first peptide selected from the group consisting of SEQ ID NO: 398, SEQ ID NO: 2000, SEQ ID NO: 2001, and SEQ ID NO: 2002; and/or (ii) a second peptide comprising a sequence selected from the group consisting of SEQ ID NO: 418, SEQ ID NO: 2062, and SEQ ID NO: 2063; and/or (iii) a third peptide comprising a sequence selected from the group consisting of SEQ ID NO: 427; SEQ ID NO: 2078, SEQ ID NO: 2079, SEQ ID NO: 2080, SEQ ID NO: 2081, SEQ ID NO: 2082, SEQ ID NO: 2083, and SEQ ID NO: 2084; and/or (iv) a fourth peptide selected from the group consisting of SEQ ID NO: 396 and SEQ ID NO: 1996; and/or (v) a fifth peptide from the group consisting of SEQ ID NO: 426 and SEQ ID NO: 2077; and/or (vi) any combination thereof. In some embodiments, the proliferative disorder is cancer. In some embodiments, the cancer is melanoma. In some embodiments, the adjuvant is selected from the group consisting of a TLR agonist, a Montanide ISA-51, and a tetanus helper peptide.

In some embodiments of the presently disclosed methods, the composition comprises at least one peptide derived from MelanA (MART-I), gp100 (Pmel 17), tyrosinase, TRP-1, TRP-2, MAGE-1, MAGE-3, BAGE, GAGE-1, GAGE-2, p15(58), CEA, RAGE, NY-ESO (LAGE), SCP-1, Hom/Mel-40, PRAME, p53, H-Ras, HER-2/neu, BCR-ABL, E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, β-Catenin, CDK4, Mum-1, p16, TAGE, PSMA, PSCA, CT7, telomerase, 43-9F, 5T4, 791Tgp72, alpha-fetoprotein, β-HCG, BCA225, BTAA, CA 125, CA 15-3 (CA 27.29\BCAA), CA 195, CA 242, CA-50, CAM43, CD68\KP1, CO-029, FGF-5, G250, Ga733 (EpCAM), HTgp-175, M344, MA-50, MG7-Ag, MOV18, NB/70K, NY-CO-1, RCAS1, SDCCAG16, TA-90 (Mac-2 binding protein/cyclophilin C-associated protein), TAAL6, TAG72, TLP, and TPS. In some embodiments, the composition is immunologically suitable for at least 60 to 88% of melanoma patients. In some embodiments, the composition comprises at least 5, 10, or 15 different target peptides. In some embodiments, the composition comprises a peptide capable of binding to an MHC class I molecule selected from the group consisting of HLA-A*0201, HLA-A*0101, HLA-A*0301, HLA-B*4402, HLA-B*0702, HLA-B*-2705 and HLA-B*1402. In some embodiments, the composition comprises a peptide capable of binding to an MHC class I molecule selected from the group consisting of HLA-A*0101, HLA-A*0301, HLA-B*4402, HLA-B*0702, HLA-B*-2705, HLA-B*1402 and combinations thereof. In some embodiments, the composition comprises a peptide capable of binding to an MHC class I molecule of the HLA-A*0201, HLA-A*0101 or HLA-B*0702 alleles. In some embodiments, the composition comprises an agent selected from the group consisting of CTLA-4 antagonists, vermurafenib, ipilimumab, dacarbazine, IL-2, temozolomide, imatinib, gefitinib, erlotinib, sunitinib, tyrphostins, a PD-1 agonist and telatinib.

In some embodiments of the presently disclosed methods, the methods increase the 5-year survival rate of the patients treated with the composition by at least 20 percent relative to average 5-year survival rates that could have been expected without treatment with the composition. In some embodiments of the presently disclosed methods, the methods are capable of increasing the overall median survival of patients treated with the composition by at least two months relative to an overall median survival that could have been expected without treatment with the composition.

In some embodiments, the presently disclosed methods further comprise the step of administering to the patient darcarbazine, carmustine, and tamoxifen.

In some embodiments, the presently disclosed methods comprise the step of administering to the patient an adjuvant selected from the group consisting of montanide ISA-51 (Seppic, Inc.), QS-21 (Aquila Pharmaceuticals, Inc.), a tetanus helper peptide, GM-CSF, cyclophosamide, *bacillus* Calmette-Guerin (BCG), *corynbacterium parvum*, levamisole, azimezone, isoprinisone, dinitrochlorobenezene (DNCB), keyhole limpet hemocyanins (KLH), Freunds adjuvant (complete and incomplete), mineral gels, aluminum hydroxide (Alum), lysolecithin, pluronic polyols, polyanions, peptides, oil emulsions, dinitrophenol, diphtheria toxin (DT).

In some embodiments of the presently disclosed methods, the target peptides are administered individually. In some embodiments, the target peptides are administered simultaneously. In some embodiments, the at least one target peptide is selected from the group consisting of SEQ ID NOs: 2164, 2165, 2166, 2167, and 2374; or a combinations thereof.

In some embodiments, the presently disclosed methods further comprise the additional step of determining that the T cell memory response is a T cell central memory response ($T_{CM}$).

The presently disclosed subject matter also provides in some embodiments kits comprising various target peptide compositions. In some embodiments, the kits also comprise an adjuvant and/or a cytokine. In some embodiments, the cytokine is selected from the group consisting of a transforming growth factor (TGF) such as but not limited to TGF-α and TGF-β; insulin-like growth factor-I and/or insulin-like growth factor-II; erythropoietin (EPO); an osteoinductive factor; an interferon such as but not limited to interferon-α, -β, and -γ; a colony stimulating factor (CSF) such as but not limited to macrophage-CSF (M-CSF); granulocyte-macrophage-CSF (GM-CSF); and granulocyte-CSF (G-CSF). In some embodiments, the cytokine is selected from the group consisting of nerve growth factors such as NGF-β; platelet-growth factor; a transforming growth factor (TGF) such as but not limited to TGF-α and TGF-β; insulin-like growth factor-I and insulin-like growth factor-II; erythropoietin (EPO); an osteoinductive factor; an interferon (IFN) such as but not limited to IFNα, IFNβ, and IFNγ; a colony stimulating factor (CSF) such as macrophage-CSF (M-CSF); granulocyte-macrophage-CSF (GM-CSF); and granulocyte-CSF (G-CSF); an interleukin (Il) such as but not limited to IL-1, IL-1α, IL-2, IL-3, IL-4, IL-5, IL-6, IL-7, IL-8, IL-9, IL-10, IL-11, IL-12; IL-13, IL-14, IL-15, IL-16, IL-17, IL-18; LIF; kit-ligand or FLT-3; angiostatin; thrombospondin; endostatin; a tumor necrosis factor (TNF); and LT. In some embodiments, the adjuvant selected from the group consisting of montanide ISA-51 (Seppic, Inc.), QS-21 (Aquila Pharmaceuticals, Inc.), a tetanus helper peptide, GM-CSF, cyclophosamide, *bacillus* Calmette-Guerin (BCG), *corynbacterium parvum*, levamisole, azimezone, isoprinisone, dinitrochlorobenezene (DNCB), keyhole limpet hemocyanins (KLH), Freunds adjuvant (complete and incomplete), mineral gels, aluminum hydroxide (Alum), lysolecithin, pluronic polyols, polyanions, peptides, oil emulsions, dinitrophenol, diphtheria toxin (DT).

In some embodiments, the presently disclosed kits further comprise an agent selected from the group consisting of CTLA-4 antagonist, vermurafenib, ipilimumab, dacarbazine, IL-2, temozolomide, imatinib, gefitinib, erlotinib, sunitinib, tyrphostins a PD-1 agonist and telatinib.

In some embodiments, the presently disclosed kit comprises at least one target peptide composition comprising at least one target peptide and a cytokine and/or an adjuvant. In some embodiments, the kit comprises at least 2, 3, 4, or 5 target peptide compositions. In some embodiments, the kit comprises a composition as disclosed herein.

In some embodiments, the presently disclosed kit further comprises at least one peptide derived from MelanA (MART-I), gp100 (Pmel 17), tyrosinase, TRP-1, TRP-2, MAGE-1, MAGE-3, BAGE, GAGE-1, GAGE-2, p15(58), CEA, RAGE, NY-ESO (LAGE), SCP-1, Hom/Mel-40, PRAME, p53, H-Ras, HER-2/neu, BCR-ABL, E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, β-Catenin, CDK4, Mum-1, p16, TAGE, PSMA, PSCA, CT7, telomerase, 43-9F, 5T4, 791Tgp72, alpha-fetoprotein, β-HCG, BCA225, BTAA, CA 125, CA 15-3 (CA 27.29\BCAA), CA 195, CA 242, CA-50, CAM43, CD68\KP1, CO-029, FGF-5, G250, Ga733 (EpCAM), HTgp-175, M344, MA-50, MG7-Ag, MOV18, NB/70K, NY-CO-1, RCAS1, SDCCAG16, TA-90 (Mac-2 binding protein\cyclophilin C-associated protein), TAAL6, TAG72, TLP and TPS.

In some embodiments of the presently disclosed kit, the at least one target peptide is selected from the group consisting of SEQ ID NOs: 2164, 2165, 2166, 2167, 2374 and combinations thereof. In some embodiments, the at least one target peptide composition comprises target peptides is selected from the HLA groupings shown in Tables 14 and 15. In some embodiments, the presently disclosed kit comprises at least two target peptides wherein the at least two target peptides are in separate containers.

In some embodiments, the presently disclosed kit further comprises instructions related to determining whether the at least one target peptide of the composition is inducing a T cell memory response that is a T cell central memory response (Tcm) in a patient.

These and other aspects and embodiments which will be apparent to those of skill in the art upon reading the specification provide the art with immunological tools and agents useful for diagnosing, prognosing, monitoring, and treating human cancers.

BRIEF DESCRIPTION OF THE FIGURES

A more complete understanding of the presently disclosed subject matter can be obtained by reference to the accompanying Figures, when considered in conjunction with the subsequent detailed description. The embodiments illustrated in the Figures are intended to be exemplary only, and should not be construed as limiting the presently disclosed subject matter to the illustrated embodiments.

FIG. 1A is a tissue microarray composed of Stage III and IV metastatic melanoma samples that were evaluated for phosphoS33-β-catenin and total β-catenin expression by immunohistochemistry (IHC). Depicted are representative samples showing the range of expression of the protein based on a quantitative staining index (SI) and range in expression were determined as described in EXAMPLES 2-16 herein below. Scale bar: 5×-250 µm; 40×-100 µm. FIGS. 1B and 1D are bar graphs showing the distribution of phosphoS33-β-catenin and total β-catenin expression levels among metastatic melanoma and normal tissue samples, respectively. FIG. 1C shows representative samples of phosphoS33-β-catenin and β-catenin expression in normal tissues by IHC. FIG. 1E is a representative tissue with strong staining for phosphoS33-β-catenin showing elevated phosphoS33-β-catenin expression in mitotic tumor cells (arrowheads) compared to non-mitotic cells (arrows) 40×; scale bar—100 µm.

FIG. 2A is a plot showing human T cells that were cultured in microwells containing irradiated stimulators pulsed with pS33-βcat$_{30}$ and evaluated for pS33-βcat-specific responses in a $^{51}$Cr-release assay after 3 and 7 weeks using targets pulsed with either the phosphorylated or unphosphorylated forms of the peptide at an effector to target ratio of 60:1 (3 weeks) and 20:1 (7 weeks). In FIGS. 2B and 2C, AAD$^+$ mice were immunized with peptide-pulsed marrow-derived dendritic cells (BMDCs) and primary responses were evaluated by intracellular cytokine staining ex vivo 7 d later. In FIGS. 2D and 2E, tecall responses were determined by priming AAD$^+$ mice with peptide-pulsed BMDCs, and boosting with peptide, CpG, and FGK45 28-30 days later. Pooled CD8$^+$ T cells isolated from spleens and lymph nodes 5 days after the boost were evaluated for cytokine production. With respect to FIGS. 2B and 2D, the dot plots shown are representative of T cell responses from individual mice, gated on CD8$^+$ cells. FIGS. 2C and 2E depict cumulative data for n=6 mice (FIG. 2C) and 7-8 mice (FIG. 2E) per group; Lines connecting the symbols link data for % IFNγ produced in response to stimulators pulsed with either the phosphopeptide or the unphosphorylated form for individual mice. Horizontal dashed lines represent the mean response. In FIG. 2F, pS33-βcat$_{30}$ and a positive control peptide, IP30, were tested for their ability to compete with a standard peptide for HLA-A2 binding. IC$_{50}$ values are as follows: pS33-βcat$_{30}$-327 ng/ml; pS33-βcat(V)$_{30}$-41 ng/ml; pS33/S37-βcat$_{30}$-678 ng/ml; and IP30-27 ng/ml. Data are representative of three independent experiments showing triplicate wells per group. Error bars represent standard error of the mean (SEM). With respect to FIG. 2G, human T cells were cultured in microwells containing irradiated stimulators pulsed with either pS33-βcat$_{30}$ or pS33-βcat(V)$_{30}$ and evaluated after 2 weeks of culture in a $^{51}$Cr-release assay using targets pulsed with the phosphopeptides or unphosphorylated peptides at an effector to target ratio of 60:1. Each symbol represents a microwell culture. Data are representative of two independent experiments using two different donors.

In FIG. 3A, human T cells were stimulated weekly with pS33-βcat(V)$_{30}$-pulsed stimulators as in FIG. 2. After 5 weeks, the proportion of CD8 T cells specific for either the modified or natural phosphopeptides was evaluated using tetramers composed of either pS33-βcat$_{30}$ or pS33-βcat(V)$_{30}$. Numbers on dot plots are % tetramer$^+$ of CD8 T cells. The Right Panel shows a summary with each set of matching symbols representing one well. Data are representative of two independent experiments using two different donors. FIG. 3B shows the results of recognition of targets pulsed with graded doses of either pS33-βcat(V)$_{30}$ or pS33-βcat$_{30}$ by CD8 T cells isolated from AAD$^+$ mice immunized with pS33-βcat(V)$_{30}$. The Left Panel shows recognition of targets pulsed with 1 µg/ml of each peptide. Each set of matching symbols represents T cells from a single mouse. The Right Panel presents representative dose response curves for CD8$^+$ T cells from one mouse. In FIG. 3C, stimulators were pulsed with graded doses of pS33-βcat$_{30}$ or pS33-βcat(V)$_{30}$, washed, and incubated with two different T cell lines immediately (solid and closed symbols) or after 40 hours of additional culture (dashed lines and open symbols). IFNγ produced by the T cells after 5 hours was assayed by ICS. Each data point is the mean value from three independent experiments. Error bars indicate SEM. For FIGS. 3B and 3C, normalized data were calculated as ((experimental value−background values for unpulsed targets)/(value at maximal phosphopeptide−pulse dose)−background value for unpulsed targets)).

FIGS. 6A, 6B, 6H, and 6I show levels of phosphoS33-β-catenin and total β-catenin from melanoma cell lines that had been incubated with or without Lactacystin to block proteasome activity were determined by Western blot. FIGS. 6A and 6H relate to data acquired with cells cultured in the absence of Lactacystin and using four times the amount of protein used for FIGS. 6B and 6I. FIGS. 6C and 6D present the results of experiments wherein integrated density values for phosphoS33-β-catenin and β-catenin were determined by scanning densitometry and normalized to those for GAPDH. pS33-βcat-specific T cell recognition data was from FIG. 4A (T cell line 5). Data were analyzed by linear regression and is representative of two independent experiments. FIG. 6E depicts sections from formalin-fixed paraffin embedded cell pellets of melanoma cells that were evaluated for the subcellular localization of β-catenin by IHC as described in EXAMPLES 2-16. Scale bar—100 μm. FIG. 6F is a graph showing recognition of the melanoma cells in each category by pS33-βcat-specific T cells from FIG. 4A (T cell line 5) assessed in triplicate. Data were representative of two independent experiments. Error bars represent SEM. FIG. 6G is a bar graph showing metastatic melanoma samples from FIG. 1 scored for subcellular localization as in FIG. 6E.

FIG. 7A) and colorectal carcinoma (SW620) and breast carcinoma cell lines (FIG. 7C) evaluated by Western blot. Data are representative of two independent experiments. With respect to FIGS. 7B and 7D, recognition of endogenously processed pS33-βcat$_{30}$ on melanoma, colorectal, or breast cancer cell lines was evaluated after incubation with pS33-βcat-specific T cell lines for 5 hours. The T cells used showed 85% (FIG. 7B) and 92% (FIG. 7D) reactivity on phosphopeptide-pulsed targets. Dot plots were gated on CD8. T cell recognition was assessed in triplicates and data is representative of two independent experiments. Error bars indicate SEM.

FIGS. 8B and 8D represent the number of subjects whose tumor samples showed high or low phosphoS33-β-catenin (FIG. 8B) or β-catenin (FIG. 8D), that were at risk over the time period ranging from the date of surgery to the last follow-up.

In FIG. 9A, two phosphopeptide-specific CTL cell lines, 6850 and 6960, that are specific for the phosphopeptide GLL-GpSPVRA (SEQ ID NO: 396), recognized the phosphopeptide on all the cancer cell lines but not the control cell line. In FIG. 9B, two phosphopeptide-specific CTL cell lines, 5183 and 63, that are specific for the phosphopeptide RVApSPTSGV (SEQ ID NO: 418), recognized the phosphopeptide on all the cancer cell lines but not the control cell line. The designation "pS" denotes a phosphoserine residue. The ordinate indicates murine IFNγ in pg/ml. The abscissa indicates each cell line.

FIG. 10A is a Venn diagram depicting the distribution of leukemia-associated phosphopeptide antigens. Distinct ALL- and AML-associated antigens were present, in contrast to CLL where all phosphoantigens were shared. HLA-B7 alleles presented a greater number of phosphopeptides than HLA-A2 alleles (see FIG. 10B) and malignant tissue expressed a greater repertoire of phosphopeptides than non-malignant tissue (see FIG. 10C). However, both HLA-A2- and HLA-B7-restricted antigens shared similar characteristics such as peptide length (FIG. 10D) and constrained phosphate position (FIG. 10E). A logoplot of residue frequency within '9mer' HLA-B7 phosphopeptides (FIG. 10F) compared against previously identified 9mer non-phosphorylated B7-bound peptides (FIG. 10G) revealed common binding traits such as P2 Proline and P9 Leucine/Phenylalanine/Methionine. Letter height in FIGS. 10F-10I is proportional to residue frequency at each position. A logoplot of in silico predicted of B7-binding phosphopeptides (FIG. 10H) revealed an even distribution of phosphoserine residues. With respect to FIG. 10I, constraining phosphoserine to P4 to agree with observed pSer preferred position for this in silico prediction revealed a P5 proline bias also seen in HLA-B7 phosphopeptides, suggesting that this bias represented and underlying kinase motif rather than HLA binding preference.

Figure 12A:
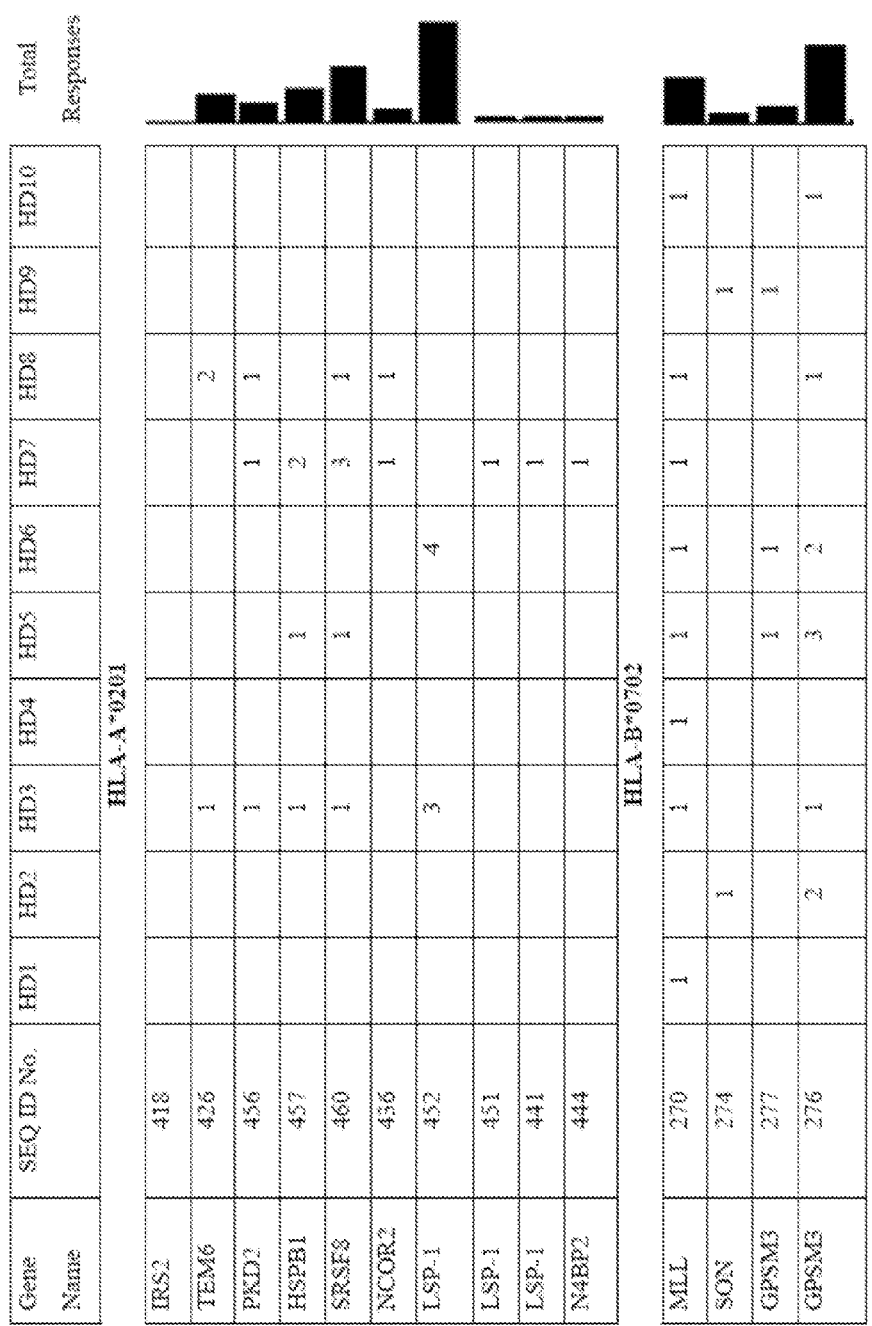
Figure 12A:
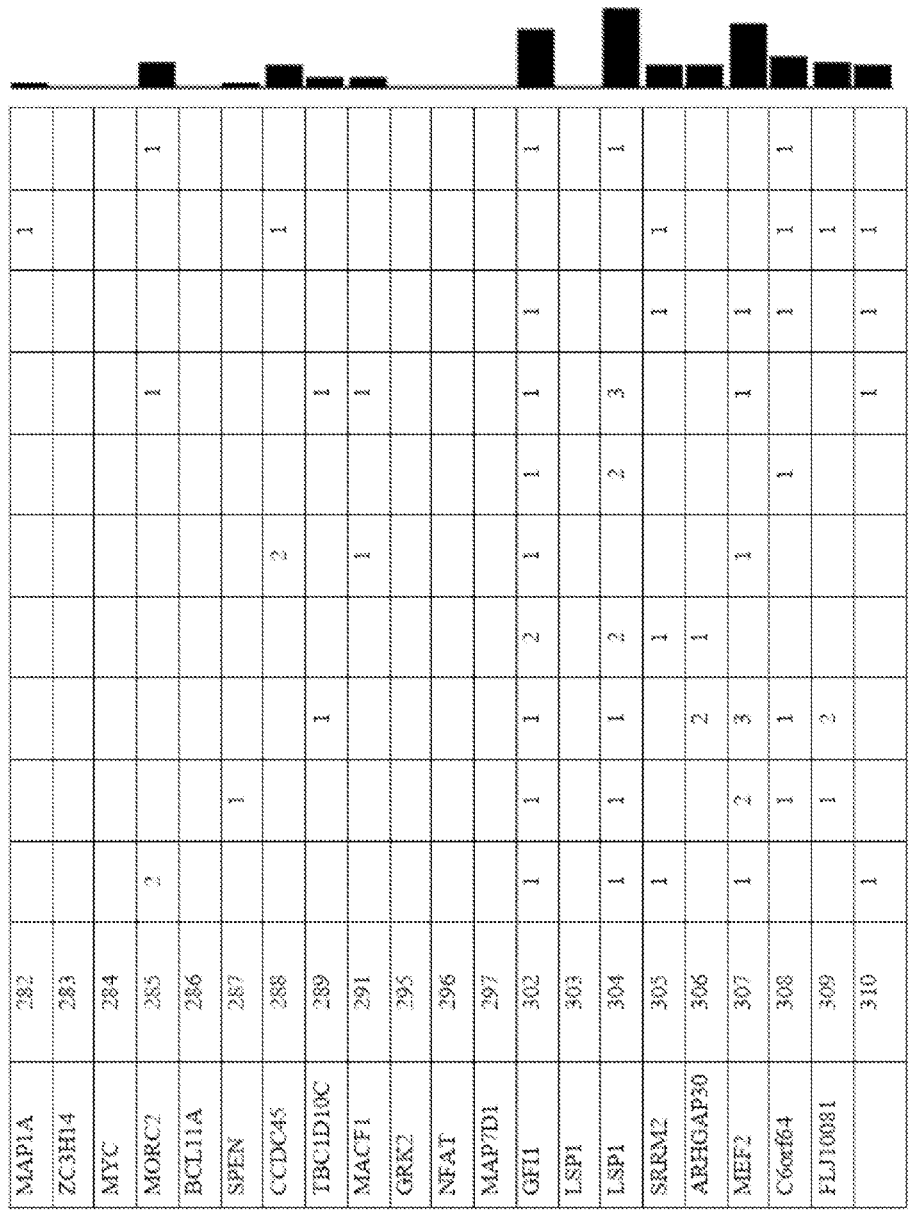
Figure 12A:
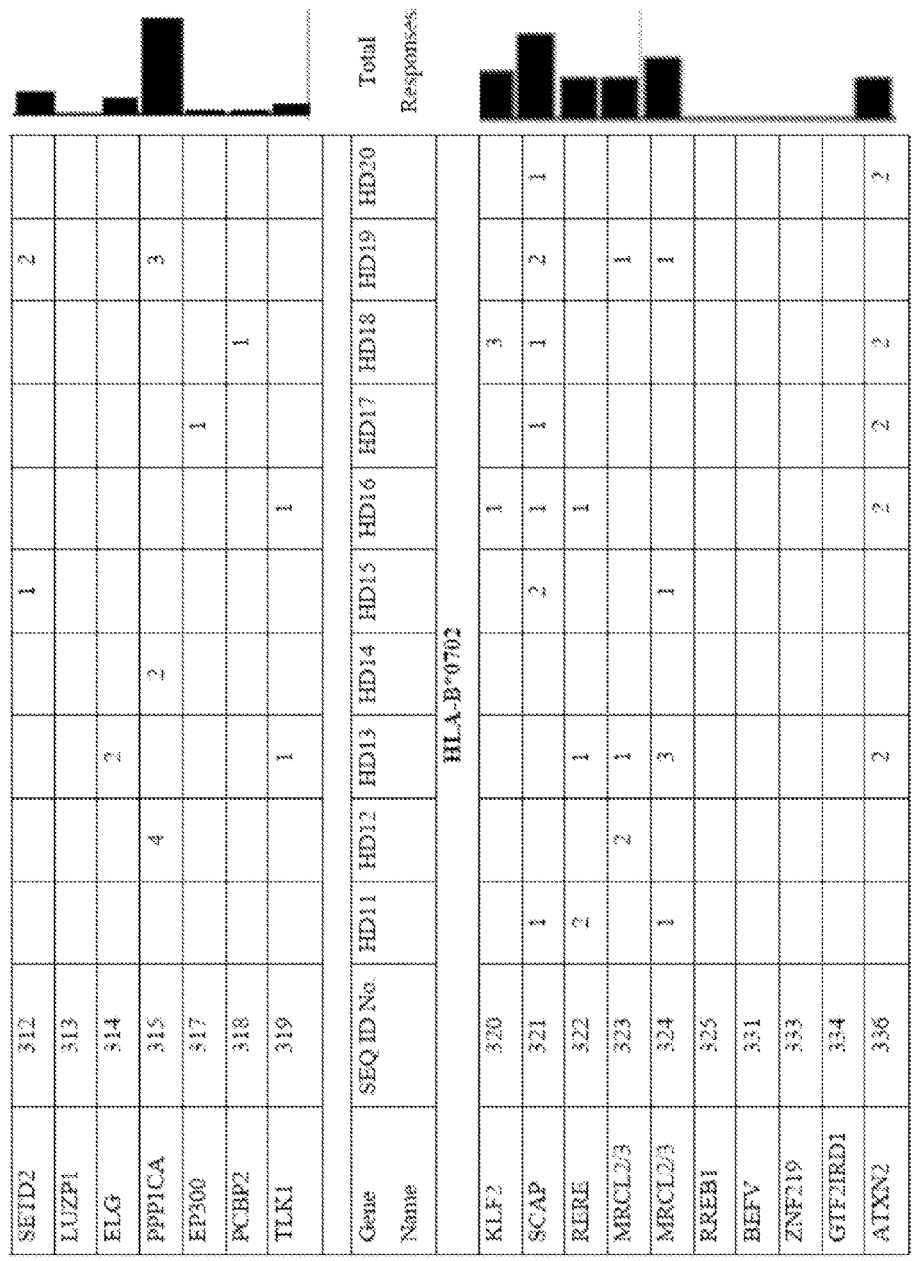
Figure 12A:
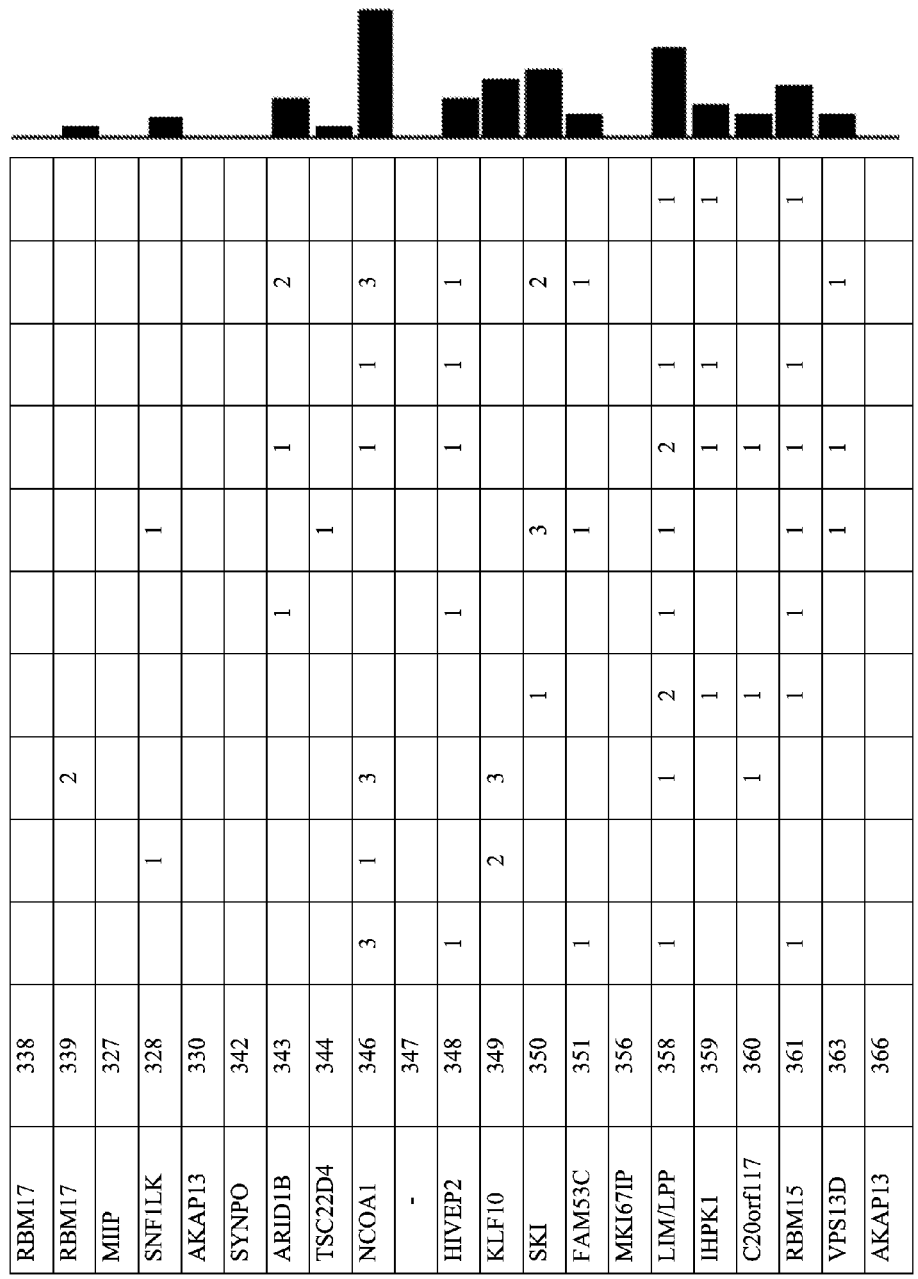
Figure 12A:
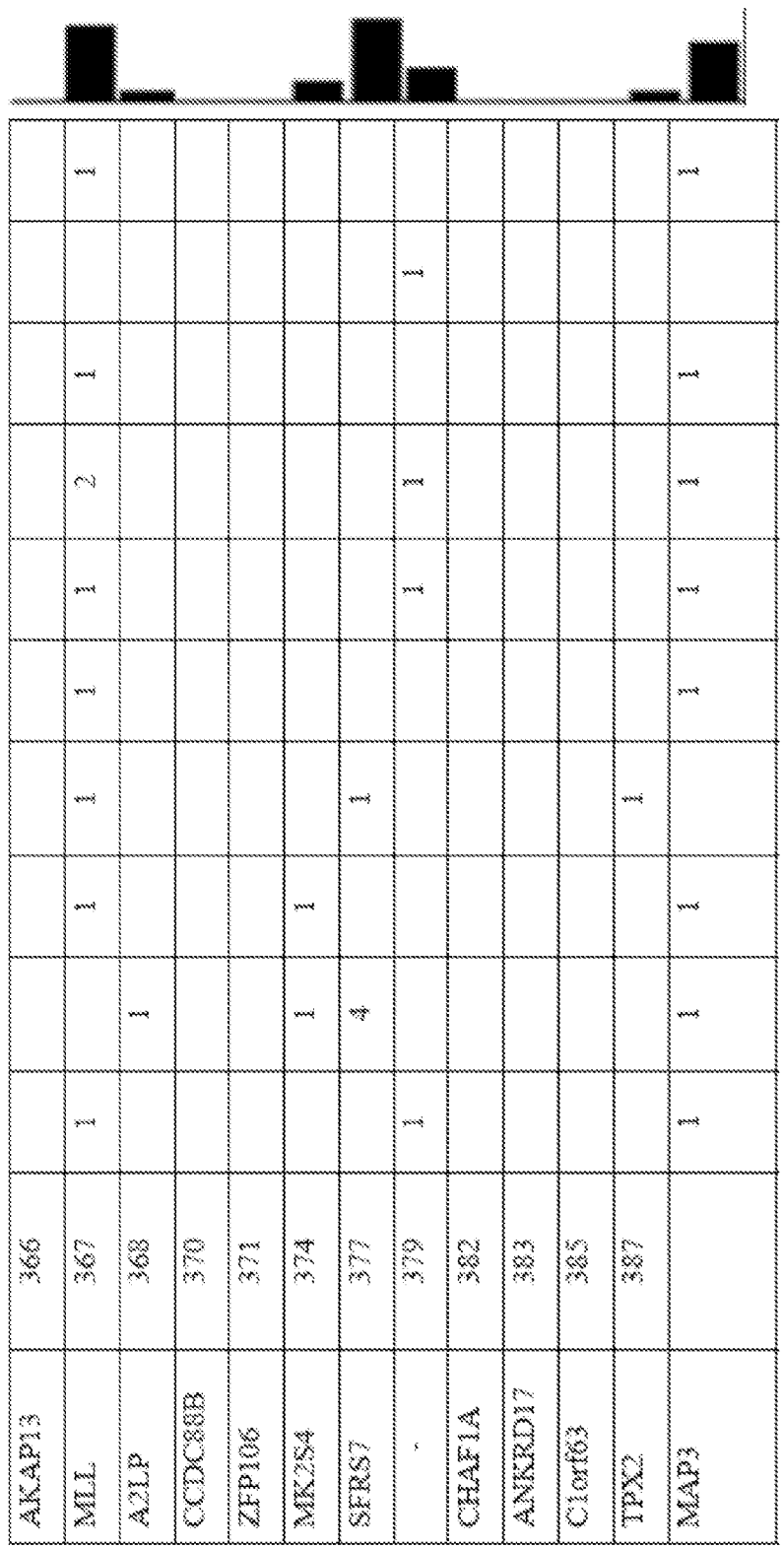
Figure 12B:
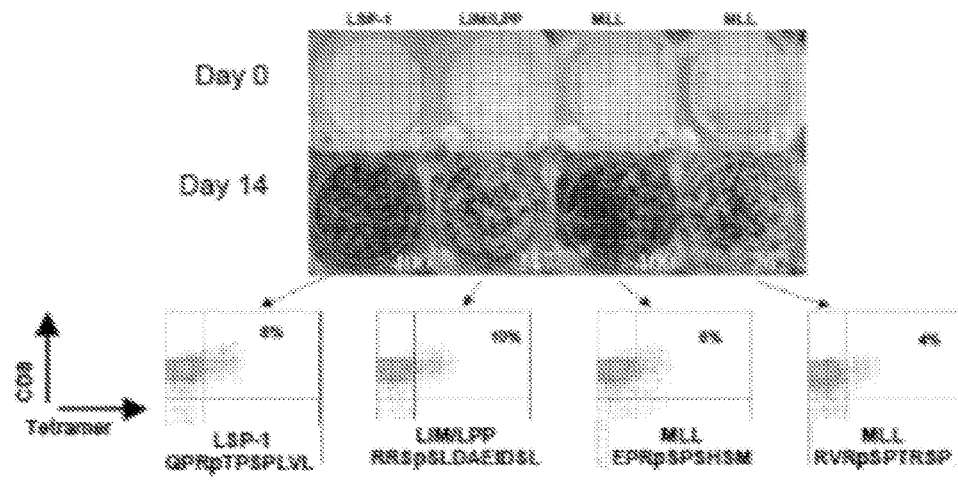
Figure 12C:
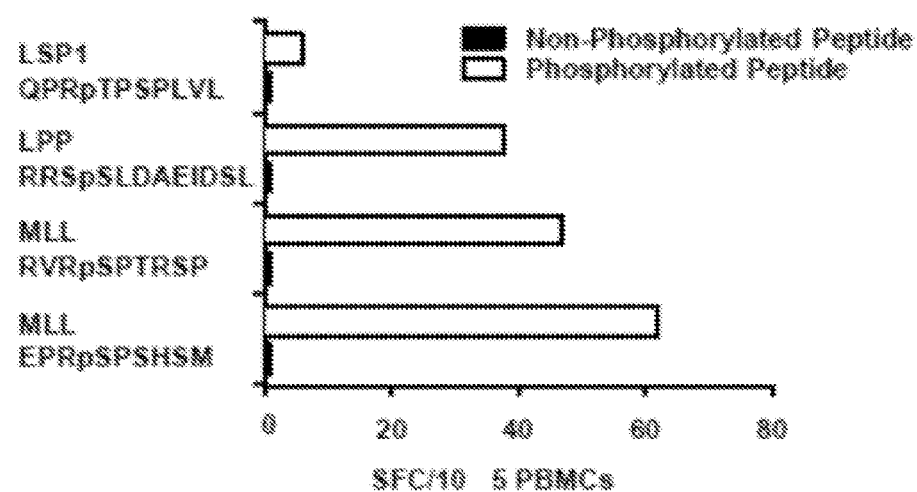
Figure 12D:
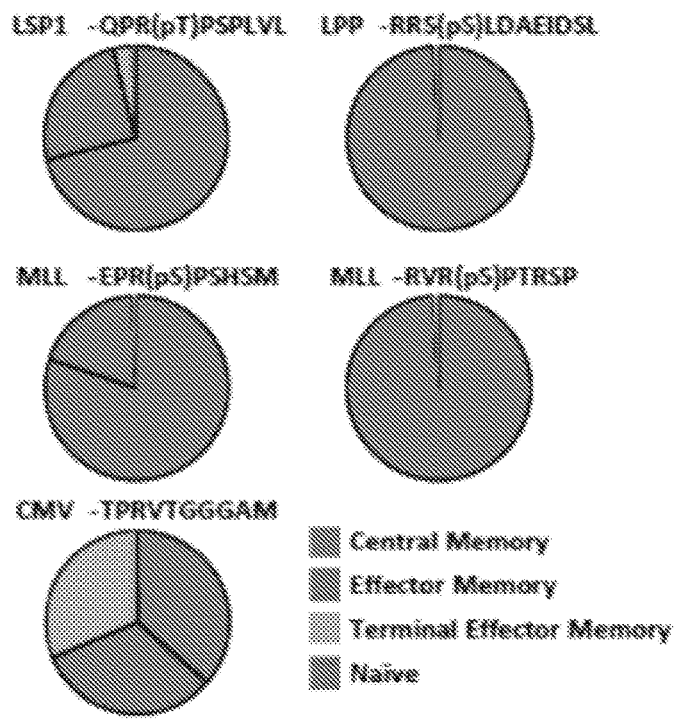
Figure 12E:
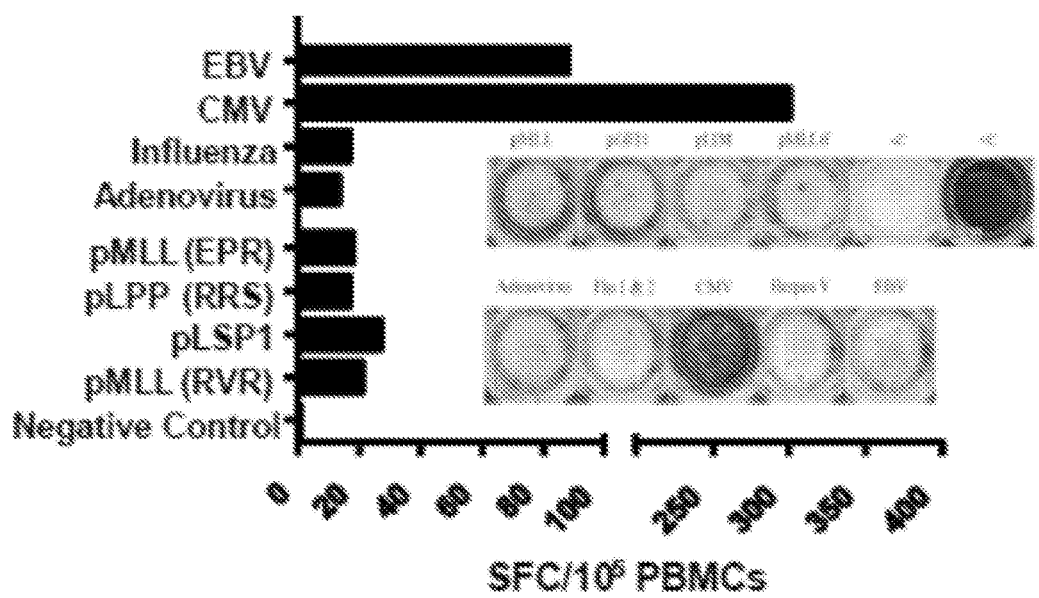

FIGS. 12A-12E summarize phosphopeptide-specific immunity in healthy individuals. FIG. 12A summarizes HLA-A2 and HLA-B7 anti-phosphopeptide immunity in ten healthy donors assessed by ELISpot over 7 day cultures with individual phosphopeptides. The data presented in columns 3-12 of FIG. 12A show the results of ELISpot T cell recognition assays. In FIG. 12A, a blank box indicates that fewer than 10 spots per 200,000 $CD8^+$ T cells were detected; "1" indicates that 11-30 spots per 200,000 $CD8^+$ T cells were detected; "2" indicates that 31-50 spots per 200,000 $CD8^+$ T cells were detected; "3" indicates that 51-100 spots per 200,000 $CD8^+$ T cells were detected; and "4" indicates that more than 100 spots per 200,000 $CD8^+$ T cells were detected. T cell-specific lines were readily generated resulting in high avidity phosphopeptide tetramer binding $CD8^+$ T cells (FIG. 12B; QPRpTPSPLVL (SEQ ID NO: 303); RRSpSLDAEIDSL (SEQ ID NO: 356); EPRpSPSHSM (SEQ ID NO: 270); RVRpSPTRSP (SEQ ID NO: 366)). Anti-phosphopeptide T cells did not recognize the non-phosphorylated counterpart peptides (FIG. 12C; QPRpTPSPLVL (SEQ ID NO: 303); RRSpSLDAEIDSL (SEQ ID NO: 356); RVRpSPTRSP (SEQ ID NO: 366); EPRpSPSHSM (SEQ ID NO: 270)) and resided mainly within the central memory (CM) $CD8^+$ T cell subset, although some anti-phosphopeptide-specific T cells also resided within the effector memory (EM) and terminal effector (TE) subsets (FIG. 12D; QPR(pT)PSPLVL (SEQ ID NO: 303); RRS(pS)LDAEIDSL (SEQ ID NO: 356); EPR (pS)PSHSM (SEQ ID NO: 270); RVR(pS)PTRSP (SEQ ID NO: 366); TPRVTGGGAM (SEO ID NO: 2380)). Three randomly chosen donors showed that frequencies of anti-phosphopeptide T cells compared to common antiviral T cell frequencies (FIG. 12E; CMV-TPRVTGGGAM (SEQ ID NO: 2380); pMLL (EPR)-EPR(pS)PSHSM (SEQ ID NO: 270); pLPP (RRS)-RRS(pS)LDAEIDSL (SEQ ID NO: 356); pLSP1-QPR(pT)PSPLVL (SEQ ID NO: 303); pMLL (RVR)-RVR(pS)PTRSP (SEQ ID NO: 366)).

FIGS. 13A-13G summarize phosphopeptide-specific immunity in patients with CLL. Comparative ELISpot analysis of enriched $CD8^+$ T cells from 14 patients with CLL and 10 healthy donors. T cells (200,000/well) were cultured with 20 µM of phosphopeptide for 16 hours. Responses to individual phosphopeptides segregate CLL patients in two groups, Group 1: absent anti phosphopeptide immunity and Group 2: present antiphosphopeptide immunity (see FIG. 13A). Overall (sum) anti-phosphopeptide responses between the groups (see FIG. 13B) and statistical significant differences among phosphopeptides tested (see FIG. 13C). ELISpot responses following mitogenic stimulation using anti-CD3 antibodies showed immunocompetence among all individuals tested (see FIG. 13D). Progression-free survival (PFS; see FIG. 13E), overall survival (OS; see FIG. 13F) and time to first treatment (TTFT; see FIG. 13G) analysis between CLL Group 1 and Group 2.

Figure 14A:
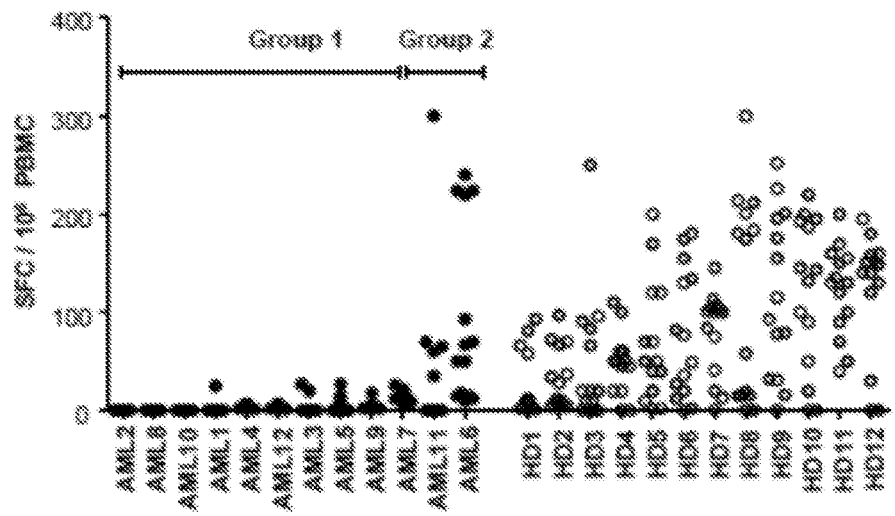
Figure 14B:
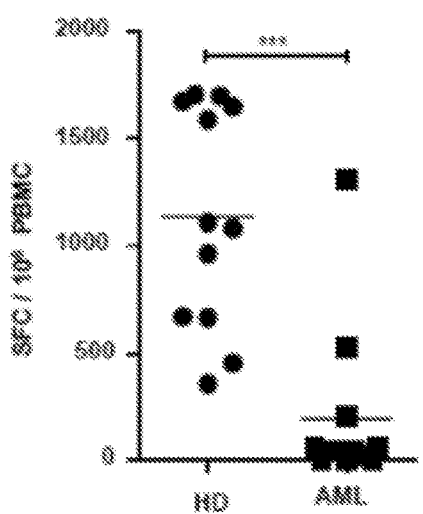
Figure 14C:
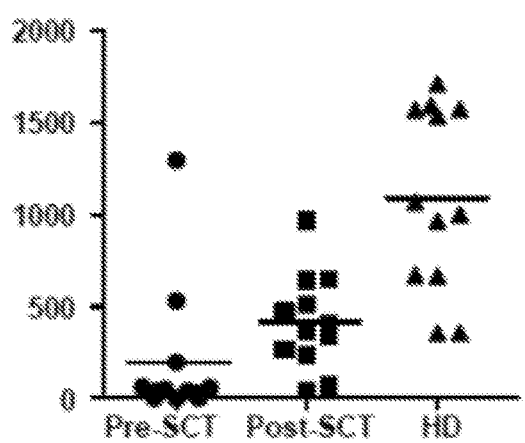
Figure 14D:
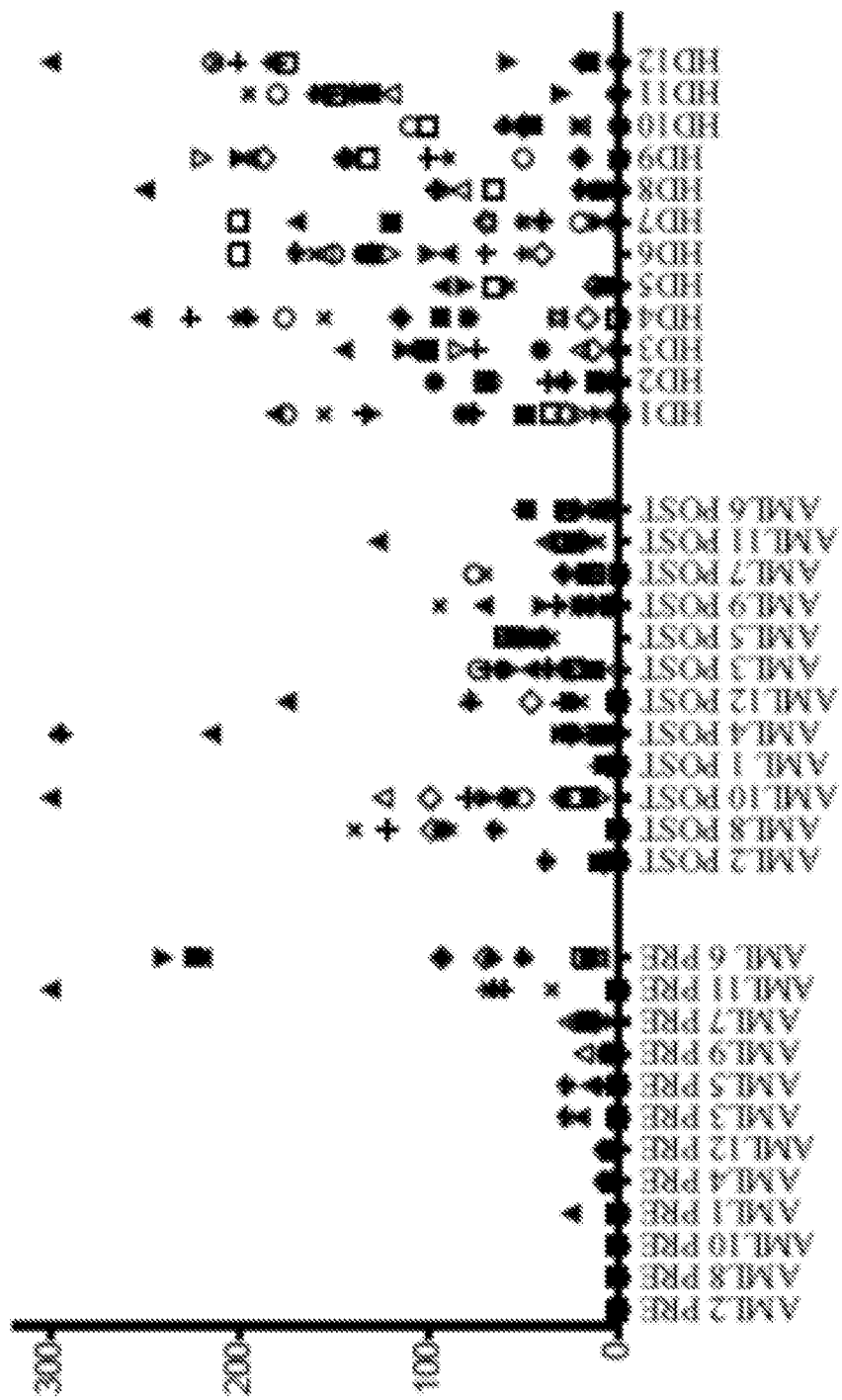
Figure 14E:
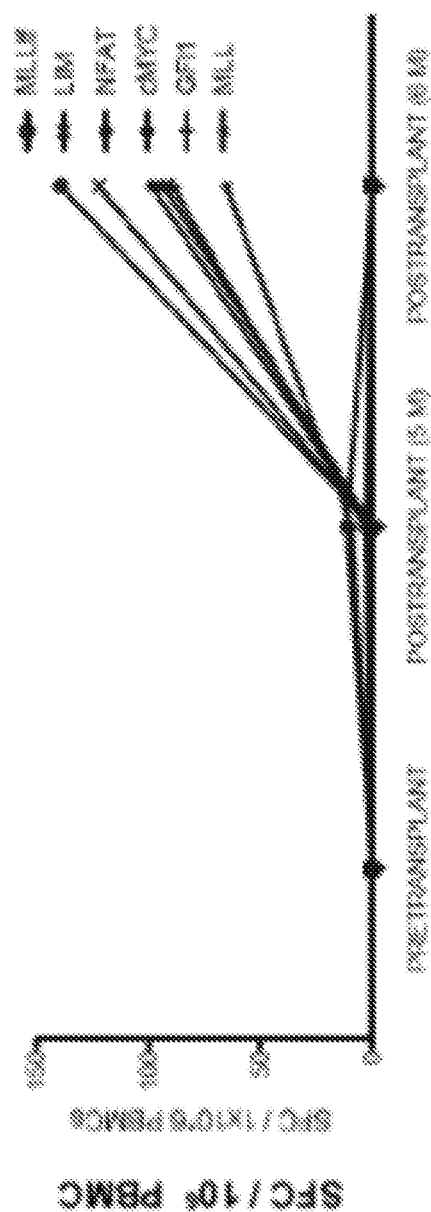

FIGS. 14A-14G summarize phosphopeptide-specific immunity in patients with AML. FIG. 14A shows comparative ELISpot analysis of PBMCs from 12 patients with AML (all with normal absolute lymphocyte counts) and 12 healthy donors. PBMCs (1×10⁶/well) were cultured with 20 µM of phosphopeptide for 7 days. Responses to individual phosphopeptides segregated AML patients in two groups: Group 1—absent or small anti phosphopeptide immunity; Group 2—present anti-phosphopeptide immunity (see FIG. 14A). Overall (sum) anti-phosphopeptide responses between the groups (see FIG. 14B) and statistical significant differences among phosphopeptides tested (see FIG. 14C). Anti-phosphopeptide immune responses following stem cell transplantation (see FIG. 14D), comparison of responses between the groups (see FIG. 14E), reconstitution over time (see FIG. 14F), and fitness (killing) of anti-phosphopeptide T cell responses (see FIG. 14G), are also shown.

Figure 15A:
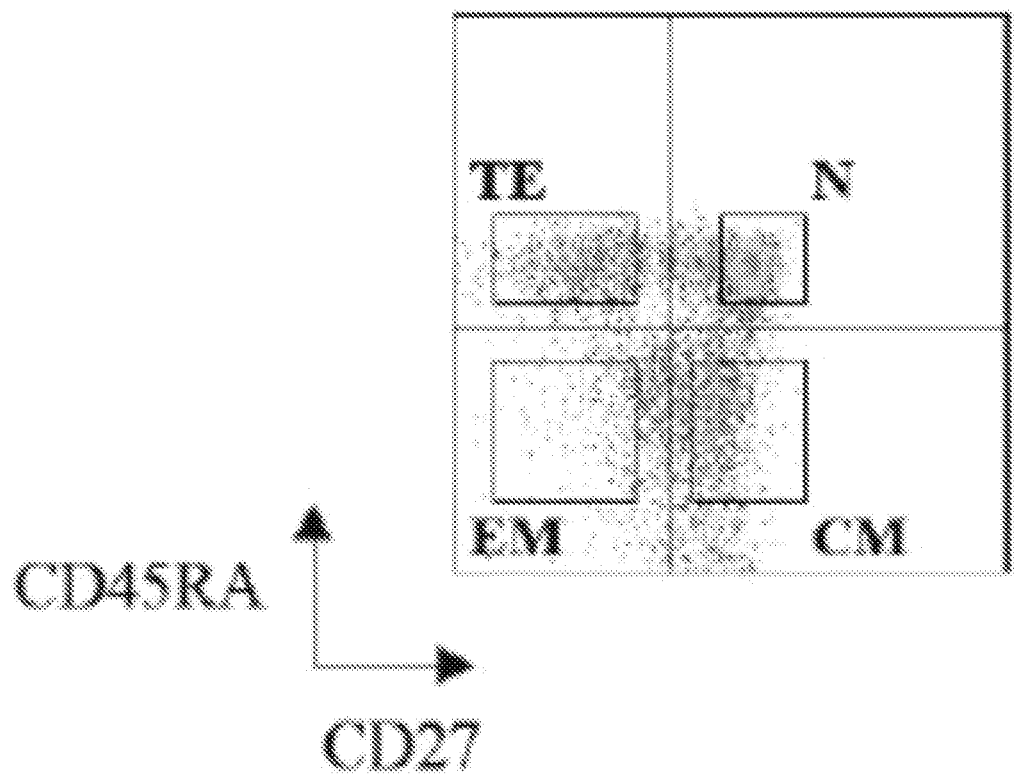
Figure 15B:
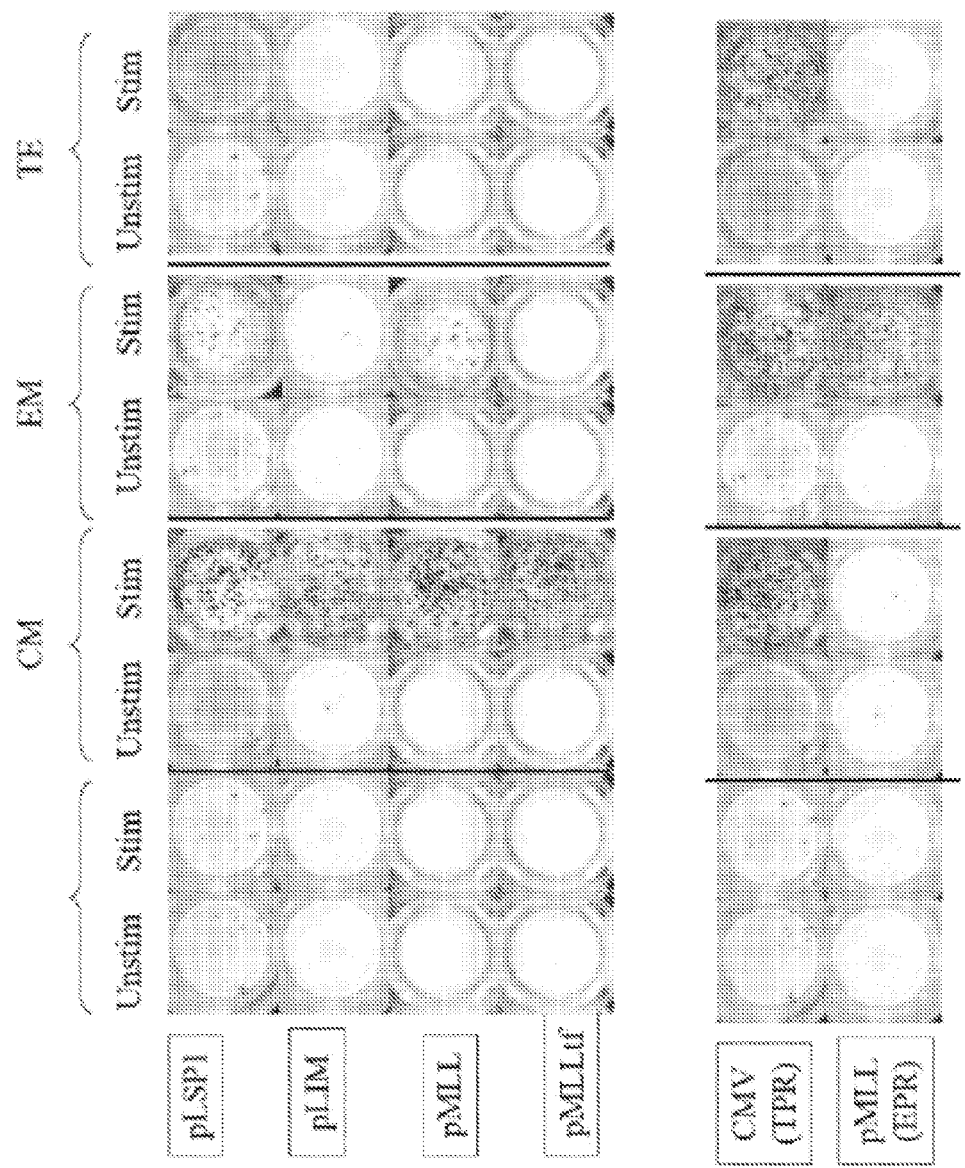

FIGS. 15A and 15B depict the results of experiments designed to determine phenotypes of phosphopeptide-specific $CD8^+$ T cells. FIG. 15A is a representative flow cytometry T cell subset profile of freshly magnetically enriched $CD8^+$ T cells from peripheral blood of healthy donors. N, naïve; CM, central memory; EF, effector memory; TE, terminal effector. FIG. 15B is a ELISpot/$CD8^+$ T cell subset mapping of anti-phosphopeptide responses following 7 day stimulations.

Figure 16:
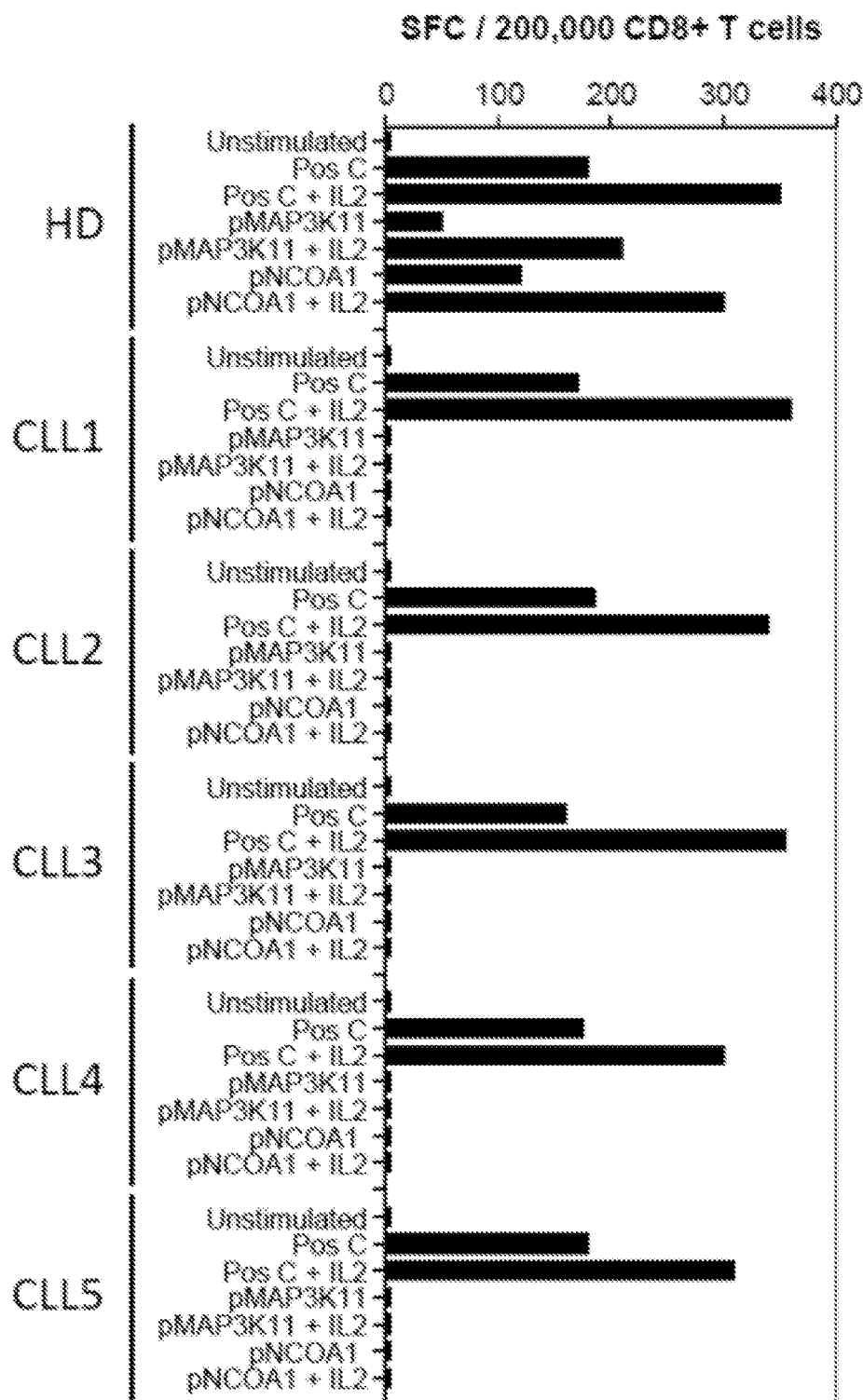

FIG. 16 is a quantitative (rather than qualitative) reduction of anti-phosphopeptide immunity in patients with CLL. FIG. 16 presents a phosphopeptide comparison between enriched $CD8^+$ T cells from a healthy donor (HD) and 5 patients with CLL who lacked antiphosphopeptide immunity stimulated in presence or absence of IL-2. Responses to anti CD3 (positive control) and two HLA-B7 restricted phosphopeptides assessed (pNCOA1 and pMAP3K11).

Figure 17:
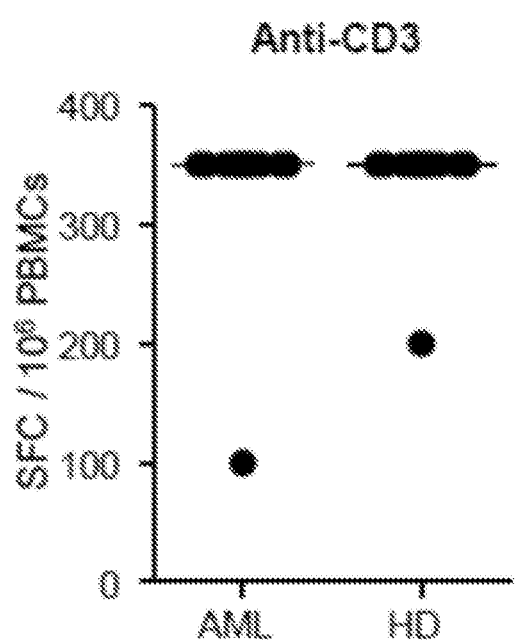

FIG. 17 is a plot of immunocompetence of patients with AML showing anti-CD3 responses measured by ELISpot among healthy donors (HD) and patients with AML.

BRIEF DESCRIPTION OF TABLES 9-24

Tables 9-19 present tables of exemplary phosphopeptides.

Table 9 lists exemplary melanoma HLA A*0301 phosphopeptides, A*0101 phosphopeptides, B*4402 phosphopeptides, B*2705 phosphopeptides, and B*1402 phosphopeptides. Table 9 further includes exemplary phosphopeptides detected on transformed B-cell lines that are also detected on leukemia, including those presented on HLA A*0301, B*0702, A*0101, and B*2705.

Table 10 lists exemplary melanoma and/or leukemia HLA B*0702 phosphopeptides.

Table 11 lists exemplary melanoma phosphopeptides detected on HLA A*0201.

Table 12 lists exemplary leukemia or transformed B-cell line phosphopeptides detected on HLA A*0201.

Table 13 lists exemplary phosphopeptides presented by class II molecules (DRB1*0404, 0101 or DRB4*0103) on melanoma and/or transformed B cells.

Table 14 lists exemplary HLA A*0201, A*0101, A*0301, B*0702, B*4402, and B*2705, and Class II MHC molecules (DRB1*0404, 0101 or DRB4*103) that can be used for immunotherapy of melanoma.

Table 15 lists exemplary HLA A*0202, A*0101, A*0301, B*0702 and Class II MHC molecules (DRB1*0404, 0101 or DRB4*103) that can be used for immunotherapy of leukemia.

Table 16 lists exemplary melanoma HLA A*0301 phosphopeptides, A*0101 phosphopeptides, B*4402 phosphopeptides, B*2705 phosphopeptides, and B*1402 phosphopeptides, and exemplary sequence variants thereof.

Table 17 lists exemplary melanoma and/or leukemia HLA B*0702 phosphopeptides, and exemplary sequence variants thereof.

Table 18 lists exemplary melanoma HLA-A*0201 phosphopeptides, and exemplary sequence variants.

Table 19 lists exemplary O-GlcNAc class I peptides.

Tables 20-22 list characteristics of HLA-DR-associated phosphopeptides selectively expressed by melanoma cells. Table 20 is a table derived from PCT International Patent Application Publication No. WO 2010/129537 that lists characteristics of HLA-DR-associated phosphopeptides selectively expressed by melanoma cells. Tables 21 and 22 are derived from Depontieu et al. (2009) *Proc Natl Acad Sci USA* 106:12073-12078, including Depontieu et al. Supplemental Information, 10.1073 *Proc Natl Acad Sci USA* 0903852106. Table 21 lists characteristics of HLA-DR-associated phosphopeptides selectively expressed by EBV-transformed B Cells. Table 22 lists characteristics of HLA-DR-associated phosphopeptides commonly expressed by melanoma and EBV-transformed B Cells.

Table 23 lists CLL cohort characteristics. In Table 23, the following abbreviations are used. NA: Not available; FC: fludarabine/cyclophosphamide; FCR: fludarabine/cyclophopshamide/rituximab; FCO: fludarabine/cyclophopshamide/ofatumumab; Chl: chlorambucil; Chl/R: chlorambucil/rituximab; Methylpred=methylprednisolone.

Table 24 provides a listing of AML cohort characteristics. In Table 24, the following abbreviations are used. MUD, matched unrelated donor; ADE, Ara-C, daunorubicin, etoposide; FLAG, fludarabine, Ara-C, idarubicin; DA, daunorubicin, Ara-c; MIDAC; amsacrine, Ara-C, etoposide, mitozantrone.

DETAILED DESCRIPTION

I. Definitions

While the following terms are believed to be well understood by one of ordinary skill in the art, the following definitions are set forth to facilitate explanation of the presently disclosed subject matter.

All technical and scientific terms used herein, unless otherwise defined below, are intended to have the same meaning as commonly understood by one of ordinary skill in the art. Mention of techniques employed herein are intended to refer to the techniques as commonly understood in the art, including variations on those techniques or substitutions of equivalent techniques that would be apparent to one of skill in the art. While the following terms are believed to be well understood by one of ordinary skill in the art, the following definitions are set forth to facilitate explanation of the presently disclosed subject matter.

Following long-standing patent law convention, the terms "a", "an", and "the" refer to "one or more" when used in this application, including the claims. Thus, in some embodiments the phrase "a peptide" refers to one or more peptides.

The term "about", as used herein to refer to a measurable value such as an amount of weight, time, dose (e.g., therapeutic dose), etc., is meant to encompass in some embodiments variations of ±20%, in some embodiments ±10%, in some embodiments ±5%, in some embodiments ±1%, in some embodiments ±0.1%, in some embodiments ±0.5%, and in some embodiments ±0.01% from the specified amount, as such variations are appropriate to perform the disclosed methods.

As used herein, the term "and/or" when used in the context of a list of entities, refers to the entities being present singly or in any possible combination or subcombination. Thus, for example, the phrase "A, B, C, and/or D" includes A, B, C, and D individually, but also includes any and all combinations and subcombinations of A, B, C, and D.

Throughout the instant disclosure and including in the Figures, phosphorylated amino acids are depicted in lower-case "s", "t", or "y" for phosphoserine, phosphothreonine, or phosphotyrosine, respectively. Alternatively, "pS' refers to phosphoserine, "pT" refers to phosphothreonine, and "pY" refers to phosphotyrosine.

II. Target Peptides

The presently disclosed subject matter relates in some embodiments to post-translationally modified immunogenic therapeutic target peptides, e.g., phosphopeptides and/or O-GlcNAc peptides, for use in immunotherapy and diagnostic methods of using the target peptides, as well as methods of selecting the same to make compositions for immunotherapy, e.g., in vaccines and/or in compositions useful in adaptive cell transfer.

In some embodiments, the target peptides of the presently disclosed subject matter are post-translationally modified by being provided with a phosphate group, (i.e., "phosphopeptides") and/or an O-linked beta-N-acetylglucosamine ("O-GlcNAc") moiety (i.e., "O-GlcNAc peptides").

The target peptides of the presently disclosed subject matter are in some embodiments not the entire proteins from which they are derived (i.e., are fragments and/or subsequences of larger polypeptides). They are in some embodiments from 8 to 50 contiguous amino acid residues of the native human protein. In some embodiments, they can contain exactly, about, or at least 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acids. The peptides of the presently disclosed subject matter can in some embodiments also have a length that falls in the ranges of 8-10, 9-12, 10-13, 11-14, 12-15, 15-20, 20-25, 25-30, 30-35, 35-40, and 45-50 amino acids. In some embodiments, exactly, about, or at least 1, 2, 3, 4, 5, 6, 7, 8, 9, 10, 11, 12, 13, 14, 15, 16, 17 or more of the amino acid residues within a recited sequence of a target peptide is phosphorylated and/or contains an O-GlcNAc moiety.

Target peptides can be modified and analogs can be synthesized that retain their ability to stimulate a particular immune response but which also gain one or more beneficial features, such as those described herein below. Thus, a particular target peptide can, for example, have use for treating and vaccinating against multiple cancer types.

Substitutions can be made in the target peptides at residues known to interact with the MHC molecule. Such substitutions can have the effect of increasing the binding affinity of the target peptides for the MHC molecule and can also increase the half-life of the target peptide-MHC complex, the consequence of which is that the substituted target peptide is a more potent stimulator of an immune response than is the original target peptide.

Additionally, in some embodiments the substitutions have no effect on the immunogenicity of the target peptide per se, but rather prolong its biological half-life and/or prevent it from undergoing spontaneous alterations which might otherwise negatively impact on the immunogenicity of the peptide.

The target peptides disclosed herein can have differing levels of immunogenicity, MHC binding, and ability to elicit CTL responses against cells displaying a native target peptide (e.g., on the surface of a tumor cell).

A phosphopeptide as disclosed herein is in some embodiments modified such that its immunogenicity and/or its binding is enhanced. In some embodiments, the modified target peptide binds to an MHC class I molecule about or at least 10%, 20%, 30%, 40%, 50%, 60%, 70%, 80%, 90%, 95%, 100%, 110%, 125%, 150%, 175%, 200%, 225%, 250%, 275%, 300%, 350%, 375%, 400%, 450%, 500%, 600%, 700%, 800%, 900%, 1000%, 10,000%, 100,000%, 1,000,000%, or more tightly than its native counterpart.

However, given the exquisite sensitivity of the T cell receptor, it cannot be foreseen whether such enhanced binding and/or immunogenicity will render a modified target peptide still capable of inducing an activated CTL that will cross react with the native target peptide being displayed on the surface of a tumor. Indeed, it is disclosed herein that the binding affinity of a target peptide does not predict its functional ability to elicit a T cell response.

Target peptides of the presently disclosed subject matter can in some embodiments be mixed together to form a cocktail. The target peptides can be in an admixture, or they can be linked together in a concatamer and/or in other arrangement as a single molecule. Linkers between individual target peptides can be used; these can, for example, be formed in some embodiments by any 10 to 20 amino acid residues. The linkers can be random sequences, or they can be optimized for degradation by dendritic cells.

In certain specified positions, a native amino acid residue in a native human protein can be altered to enhance its binding to an MHC class I molecule. These occur in "anchor" positions of the target peptides, often in positions 1, 2, 3, 9, or 10. Valine, alanine, lysine, leucine tyrosine, arginine, phenylalanine, proline, glutamic acid, threonine, serine, aspartic acid, tryptophan, and methionine can also be used as improved anchoring residues. Anchor residues for different HLA molecules are listed below in Table 1.

TABLE 1

Anchor Residues for HLA Molecules

| HLA Type | Residue Position | Anchor Residue(s) |
|---|---|---|
| HLA A*0201 | 2 | L, M |
| | 9 or Last | V |
| HLA A*0301 | 2 | L, M |
| | 9 or Last | K |
| HLA A*0101 | 2 | T, S |
| | 3 | D, E |
| | 9 or Last | Y |
| HLA B*2705 | 1 | R |
| | 2 | R |
| | 9 or Last | L, F, K, R, M |
| HLA B*0702 | 2 | P |
| | 9 or Last | L, M, V, F |
| HLA B*4402 | 2 | E |
| | 9 or Last | F, Y, W |

In some embodiments, the immunogenicity of a target peptide is measured using transgenic mice expressing human MHC class I genes. For example, "ADD Tg mice" express an interspecies hybrid class I MHC gene, AAD, which contains the α-1 and α-2 domains of the human HLA-A2.1 gene and the α-3 transmembrane and cytoplasmic domains of the mouse H-2Dd gene, under the transcriptional control of the human HLA-A2.1 promoter. Immunodetection of the HLA-A2.1 recombinant transgene established that expression was at equivalent levels to endogenous mouse class I molecules. The mouse α-3 domain expression enhances the immune response in this system. Compared to unmodified HLA-A2.1, the chimeric HLA-A2.1/H2-Dd MHC Class I molecule mediates efficient positive selection of mouse T cells to provide a more complete T cell repertoire capable of recognizing peptides presented by HLA-A2.1 Class I molecules.

The peptide epitopes presented and recognized by mouse T cells in the context of the HLA-A2.1/H2-Dd class I molecule are the same as those presented in HLA-A2.1$^+$ humans. This transgenic strain enables the modeling of human T cell immune responses to HLA-A2 presented antigens, and identification of those antigens. This transgenic strain is a preclinical model for design and testing of vaccines for infectious diseases or cancer therapy involving optimal stimulation of CD8$^+$ cytolytic T cells.

In some embodiments, the immunogenicity of a modified phosphopeptide is determined by the degree of Interferon gamma (IFNγ) and/or tumor necrosis factor-alpha (TNF-α) production of T cells from ADD Tg mice immunized with the target peptide, e.g., by immunization with target peptide pulsed bone marrow derived dendritic cells.

In some embodiments, the modified target peptides are about or at least 10, 20, 30, 40, 50, 60, 70, 80, 90, 95, 100, 110, 125, 150, 175, 200, 225, 250, 275, 300, 350, 375, 400, 450, 500, 600, 700, 800, 1000, 1500, 2000, 2500, 3000, 4000, 5000% or more immunogenic, e.g., in terms of numbers of IFNγ- and/or TNF-α-positive (i.e., "activated") T cells relative to numbers elicited by native target peptides in ADD Tg mice immunized with phosphopeptide-pulsed bone marrow derived dendritic cells (BMDCs). In some embodiments, the target peptides are modified target peptides. In some embodiments, the modified target peptides are able to elicit CD8$^+$ T cells that are cross-reactive with the modified and the native target peptide in general and when such modified and native target peptides are complexed with MHC class I molecules in particular. In some embodiments, the CD8$^+$ T cells that are cross-reactive with the modified and the native target peptides are able to reduce tumor size by about or at least 10%, 20%, 30%, 40%, 50%, 60%, 70%, 80%, 90%, 95%, 97% or 99% in a NOD/SCID/IL-2Rγc$^{-/-}$ knock out mouse relative to IL-2 treatment without such cross-reactive CD8$^+$ T cells.

The phrase "capable of inducing a target peptide-specific memory T cell response in a patient" as used herein relates to eliciting a response from memory T cells (also referred to as "antigen-experienced T cell"), which are a subset of infection- and cancer-fighting T cells that have previously encountered and responded to their cognate antigen. Such T cells can recognize foreign invaders, such as bacteria or viruses, as well as cancer cells. Memory T cells have become "experienced" by having encountered antigen during a prior infection, having encountered cancer, or via previous vaccination. At a second encounter with the cognate antigen (e.g., by way of an initial inoculation with a target peptide of the presently disclosed subject matter), memory T cells can reproduce to mount a faster and stronger immune response than the first time the immune system responded to the invader (e.g., through the body's own consciously unperceived recognition of a target peptide being associated with diseased tissue). This behavior can be assayed in T lymphocyte proliferation assays, which can reveal exposure to specific antigens.

Memory T cells comprise two subtypes: central memory T cells ($T_{CM}$ cells) and effector memory T cells ($T_{EM}$ cells). Memory cells can be either CD4$^+$ or CD8$^+$. Memory T cells typically express the cell surface protein CD45RO. Central memory ($T_{CM}$) cells generally express L-selectin and CCR7, and they secrete IL-2 but not IFNγ or IL-4. Effector memory ($T_{EM}$) cells, however, generally do not express L-selectin or CCR7 but produce effector cytokines like IFNγ and IL-4.

A memory T cell response generally results in the proliferation of memory T cells and/or the upregulation or increased secretion of factors such as CD45RO, L-selectin, CCR7, IL-2, IFNγ, CD45RA, CD27, and/or IL-4. In some embodiments, the target peptides of the presently disclosed subject matter are capable of inducing a $T_{CM}$ cell response associated with L-selectin, CCR7, IL,-2 but not IFNγ or IL-4 expression and/or secretion. See e.g., Hamann et al., 1997. In some embodiments, a $T_{CM}$ cell response is associated with an at least or an about 1%, 5%, 10%, 15%, 20%, 25%, 30%, 35%, 45%, 50%, 55%, 60%, 65%, 70%, 75%, 80%, 90%, 95%, 97%, 98%, 99%, 100%, 125%, 150%, 175%, 200%, 250%, 300%, 400%, 500%, 600%, 700%, 800%, 900%, 1000%, 1500%, 2000% or more increase in T cell CD45RO/RA, L-selectin, CCR7, or IL-2 expression and/or secretion.

In some embodiments, the target peptides of the presently disclosed subject matter are capable of inducing a CD8$^+$ $T_{CM}$ cell response in a patient the first time that patient is provided the composition including the selected target peptides. As such, the target peptides of the presently disclosed subject matter can in some embodiments be referred to as "neo-antigens." Although target peptides might be considered "self" for being derived from self-tissue, they generally are only found on the surface of cells with a dysregulated metabolism (e.g., aberrant phosphorylation), and they are likely never presented to immature T cells in the thymus. As such, these "self" antigens act are neo-antigens because they are nevertheless capable of eliciting an immune response.

In some embodiments, about or at least 1%, 5%, 10%, 15%, 20%, 25%, 30%, 35%, 45%, 50%, 55%, 60%, 65%, 70%, 75%, 80%, 90%, 95%, 97%, 98%, or 99% of T cells activated by particular target peptide in a particular patient sample are $T_{CM}$ cells.

In some embodiments, a patient sample is isolated exactly, about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more days after an initial exposure to a particular target peptide and then assayed for target peptide-specific activated T cells and the proportion of $T_{CM}$ cells thereof.

In some embodiments, the compositions of the presently disclosed subject matter are able to elicit a CD8$^+$ $T_{CM}$ cell response in at least or about 1%, 5%, 10%, 15%, 20%, 25%, 30%, 35%, 45%, 50%, 55%, 60%, 65%, 70%, 75%, 80%, 90%, 95%, 97%, 98%, or 99% of patients and/or healthy volunteers.

In some embodiments, the compositions of the presently disclosed subject matter are able to elicit a CD8$^+$ $T_{CM}$ cell response in about or at least 1%, 5%, 10%, 15%, 20%, 25%, 30%, 35%, 45%, 50%, 55%, 60%, 65%, 70%, 75%, 80%, 90%, 95%, 97%, 98%, 99% of patients and/or healthy volunteers specific, and in some embodiments the CD8$^+$ $T_{CM}$ cell response elicited is directed against all or at least or about 1, 2, 3, 4, 5, 6, 7, 8, 9, 10, or more target peptides that are present in the composition. In some embodiments, the aforementioned T cell activation tests are done by ELISpot assay.

II.A. O-GlcNAc Peptides

The term "O-GlcNAc peptides" includes MHC class I- and MHC class II-specific O-GlcNAc peptides. Exemplary MHC class I target peptides set forth in Table 19.

Modification of proteins with O-linked β-N-acetylglucosamine (O-GlcNAc) was previously technically difficult to detect. However, it rivals phosphorylation in both abundance and distribution of the protein targets for this modification. Like phosphorylation, O-GlcNAcylation is a reversible modification of nuclear and cytoplasmic proteins and is characterized by the attachment of a single β-N-acetylglucosamine moiety to a hydroxyl group of a serine or a threonine residue. Modification by O-GlcNAcylation is often competitive with phosphorylation at the same sites or at proximal sites on proteins. Furthermore, crosstalk between O-GlcNAcylation and phosphorylation affects the posttranslational state of hundreds of proteins in response to nutrients and stress, and plays an important role in chronic diseases of metabolism such as but not limited to diabetes and neurodegeneration.

O-GlcNAc transferase (OGT) catalyzes the addition of the sugar moiety from the donor substrate uridine 5'-diphosphate (UDP)-GlcNAc to proteins. During M phase, OGT localizes to discrete structures, such as centrosomes (metaphase) and the spindle (anaphase), and then moves to the midbody during cytokinesis. OGT along with O-GlcNAcase (OGA), the enzyme that removes the sugar, dynamically interact with Aurora Kinase B (AURKB) and protein phosphatase 1 (PP1) at the midbody. Together, these proteins form a complex regulating M-phase OGlcNAcylation, which in turn influences the phosphorylation state, of vimentin. However, the identity of other OGT mitotic substrates is currently not known.

Peptides modified with O-GlcNAc can be difficult to detect by standard mass spectrometric methods. The modification is usually present at sub-stoichiometric amounts, modified and unmodified peptides co-elute during high-performance liquid chromatography (HPLC), and ionization of the modified peptide is suppressed in the presence of unmodified peptides. Consequently, sample enrichment is often required to successfully detect and characterize OGlcNAcylated peptides. Enrichment can be achieved through chemoenzymatic approaches that biotinylate O-GlcNAc peptides and capture them by avidin chromatography.

Alternatively, a chemoenzymatic approach using a photocleavable biotin-alkyne reagent (PCbiotin-alkyne) tag can be used. See e.g., Figure S1A of Wang et al., 2010 ("Wang"), herein incorporated by reference. Photocleavage not only allows efficient and quantitative recovery from the affinity column, but also tags the peptide with a charged moiety that facilitates O-GlcNAc site mapping by electron-transfer dissociation (ETD) mass spectrometry. This tagging approach also makes it possible to use conventional collision-activated dissociation mass spectrometry (CAD MS) to screen samples for the presence of O-GlcNAc-modified peptides by monitoring for two-signature fragment ions characteristic of the tag (see Figure S1B of Wang).

OGlcNAcylation rivals phosphorylation in both abundance and distribution of the modified proteins and alterations in O-GlcNAcylation disrupt both the chromosomal passenger complex—containing AURKB, inner centromere protein antigens 135/155 kDa (INCENP), PP1, Borealin, and Survivin—and the circuits regulating CDK1 activity.

O-GlcNAc moieties are nearly as abundant as phosphates on proteins associated with the spindle and midbody. Many of the O-GlcNAcylation sites identified are identical or proximal to known phosphorylation sites. O-GlcNAcylation and phosphorylation work together to control complicated mitotic processes, such as spindle formation. For example, OGT overexpression altered the abundance of transcripts and proteins encoded by several mitotic genes, changed the localization of NuMA1, and disrupted the chromosomal passenger complex and the CDK1 activation circuit.

An interplay exists between O-GlcNAcylation and phosphorylation for several protein classes, most noticeably transcriptional regulators and cytoskeletal proteins. Many of the O-GlcNAcylation and phosphorylation sites are located in the regulatory head domains of intermediate filament proteins. Phosphorylation of these sites causes filament disassociation during M phase. For example, vimentin is phosphorylated at multiple sites during M phase and there is an O-GlcNAcylation site that is also a mitotic phosphorylation site (Ser55; Slawson et al., 2005; Slawson et al., 2008; Wang et al., 2007; Molina et al., 2007). There three additional O-GlcNAcylation sites on vimentin at Ser7, Thr33, and Ser34 (see Tables S5 and S6 of *Wang*), all of which are in the regulatory head domain of the protein. Two of these, Ser7 and Ser34, are also phosphorylation sites (Dephoure et al., 2008; Molina et al., 2007). Signaling pathways involving cytoskeletal proteins are regulated by reciprocal occupancy on specific sites by phosphate and O-GlcNAc. In these classes of molecules, areas of multiple phosphorylations are also likely to be targeted for OGlcNAcylation.

OGT overexpression profoundly affects multiple mitotic signaling circuits. Although overexpression of OGT does not interfere with the formation of the midbody complex or localization of AURKB, AURKB activity is altered toward the cytoskeletal protein, vimentin. The reduction in the abundance of AURKB or INCENP dampens kinase activity to a point that retards mitotic progression especially during anaphase and telephase. Furthermore, OGT overexpression reduced phosphorylation of INCENP and borealin, but to what extent this alters the function of the midbody complex is unclear.

Multiple components of the cyclin B/CDK1 activation circuit were disrupted by the overexpression of OGT. The loss of PLK1 inhibitory phosphorylation on MYT1 and the increase in the abundance of MYT1 are likely contributors to the loss in cyclin B-CDK1 activity observed in OGT-overexpressing cells (see FIG. 7 of *Wang*). However, the reduction in cyclin B-CDK1 activity is likely only partially due to the increase in MYT1 activity, because the mRNA for CDC25C, the key CDK1 dual-specific phosphatase, is substantially reduced. The "on" switch for CDK1 activation, the reduction of MYT1 and the increase in CDC25C activity, is pushed toward "off" by OGT overexpression. Both MYT1 and CDC25C are substrates for PLK1. The protein and transcript abundance of PLK1 is substantially reduced in response to OGT overexpression, but there is little change in the extent of activating phosphorylation of PLK1.

Because O-GlcNAcylation is directly coupled to nutrient uptake and metabolism, the sugar residue is an ideal metabolic sensor for regulating mitotic progression. Whereas, phosphorylation might act as a master switch initiating the mitotic process, O-GlcNAcylation could act as an adjuster of signals to make these processes more responsive to environmental cues. How O-GlcNAcylation exerts control on specific mitotic proteins and how OGlcNAcylation will integrate into well known signaling pathways represent another layer of cellular regulation.

II.B. Phosphopeptides

The term "phosphopeptides" includes MHC class I- and MHC class II-specific phosphopeptides. Exemplary MHC class I phosphopeptides are set forth in Tables 9-22, for example.

In some embodiments, the phosphopeptides contain the sequences of at least one of the MHC class I binding peptides listed in SEQ ID NO. 1-2163. Moreover, in some embodiments about, or at least 1, 2, 3, 4, 5, 6, 7, 8, 9, 10, 11, 12, 13, 14, 15 or more of the serine, homo-serine, threonine, or tyrosine residues within the recited sequences is phosphorylated. The phosphorylation can be with a natural phosphorylation ($-CH_2-O-PO_3H$) or with an enzyme non-degradable, modified phosphorylation, such as but not limited to $-CH_2-CF_2-PO_3H$ or $-CH_2-CH_2-PO_3H$. Some phosphopeptides can contain more than one of the peptides listed in SEQ ID NO: 1-2163, for example, if they are overlapping, adjacent, or nearby within the native protein from which they are derived.

The chemical structure of a phosphopeptide mimetic appropriate for use in the presently disclosed subject matter can in some embodiments closely approximate the natural phosphorylated residue which is mimicked, and also be chemically stable (e.g., resistant to dephosphorylation by phosphatase enzymes). This can be achieved with a synthetic molecule in which the phosphorous atom is linked to the amino acid residue, not through oxygen, but through carbon. In some embodiments, a $CF_2$ group links the amino acid to the phosphorous atom Mimetics of several amino acids which are phosphorylated in nature can be generated by this approach. Mimetics of phosphoserine, phosphothreonine, and phosphotyrosine can be generated by placing a $CF_2$ linkage from the appropriate carbon to the phosphate moiety. The mimetic molecule L-2-amino-4(diethyl-phosphono)-4,4-difluorobutanoic acid (F2Pab) can substitute for phosphoserine (Otaka et al., 1995). L-2-amino-4-phosphono-4,4-difluoro-3-methylbutanoic acid (F2Pmb) can substitute for phosphothreonine, and L-2-amino-4-phosphono (difluoromethyl)phenylalanine (F2Pmp) can substitute for phosphotyrosine (Smyth et al., 1992; Akamatsu et al., 1997). Alternatively, the oxygen bridge of the natural amino acid can be replaced with a methylene group. In some embodiments, serine and threonine residues are substituted with homo-serine and homo-threonine residues, respectively.

Disclosed herein is the expression of β-catenin phosphorylated at S33 in human metastatic melanoma tissues and melanoma and breast cancer cell lines. Also disclosed is the immunotherapeutic potential of the decapeptide YLD(pS) GIHSGA (SEQ ID NO: 427), alternatively referred to herein as "pS33-βcatenin$_{30-39}$" or "pS33-βcat$_{30}$", which corresponds to amino acids 30-39 of human β-catenin (CTNNB1) with a phosphoserine in the fourth position (i.e., amino acid 33 of human CTNNB1), and a modified form of the same phosphopeptide, pS33-βcat(V)$_{30}$ (see below).

pS33-βcat$_{30}$ (SEQ ID NO: 427) is broadly and sufficiently presented by melanoma and breast cancer cells and is therefore a good target for cancer immunotherapy. However, pS33-βcat$_{30}$ as a phosphopeptide is a very weak immunogen in vivo. Secondary responses in mice elicited with pS33-βcatenin$_{30-39}$ together with CpG and anti-Cd40 as adjuvants were almost undetectable. As such, it is not ideally suited for inclusion in a phosphopeptide composition vaccine.

Although not wishing to be bound by any particular theory, the weak in vivo immunogenicity of pS33-βcat$_{30}$ could be because it binds with low affinity to HLA-A*0201. Indeed, direct measurement indicated that it has a relatively low affinity.

pS33-βcatenin$_{30-39}$ (SEQ ID NO: 427) was modified by replacing the Ala residue at the P10 position (amino acid 39 of human CTNNB1) with a Val residue. This modified peptides is referred to herein as pS33-βcatenin$_{30-39}$(V), and it corresponds to SEQ ID NO: 2080. The Ala to Val modification enhanced the HLA-A2 binding affinity by about 10 fold.

Alternatively, immunization of AAD Tg mice with pS33-βcat(V)$_{30}$ induced discernable primary and memory recall CD8 T cell responses. These T cells also specifically recognized the phosphorylated but not the unphosphorylated form of the modified peptide. pS33-βcat(V)$_{30}$ induced measurable in vitro human CD8 T cell responses after only 2 weeks, at which time no specific responses to pS33-βcat$_{30}$ were detected. MHC-restricted peptides, even with conservative modifications, can thus elicit T cells incapable of recognizing the original epitope (Bertoletti et al., 1994; Klenerman et al., 1994).

Surprisingly, pS33-βcat(V)$_{30}$ elicited activated CD8 T cells that demonstrated a high level of crossreactivity against the natural pS33-βcat$_{30}$ phosphopeptide. Moreover, pS33-βcat-specific T cells significantly delayed melanoma tumor outgrowth in NOD/SCID mouse model. Given that the pS33-βcat$_{30}$ and pS33-βcat(V)$_{30}$ are antigenically distinct one might foresee a decrease in response to the pS33-βcatenin$_{30-39}$ with increasing inoculation pS33-βcat(V)$_{30}$ antigen. However, a 10-fold increase in pS33-βcat(V)$_{30}$ antigen dose resulted in a sizeable increase in the magnitude of the response and only a modest decrease in the average avidity for pS33-βcatenin$_{30-39}$. Moreover, the level of crossreactivity on pS33-βcatenin$_{30-39}$ was not adversely impacted by increasing antigen dose.

Surprisingly, therefore, modification of pS33-βcat$_{30}$ to enhance its binding affinity for HLA-A*0201 not only also enhanced its immunogenicity in both humans and mice, but also enabled the generation of activated human CD8$^+$ T cells crossreactive with the native pS33-βcat$_{30}$/HLA-A*0201 complex. It was unexpectedly found that pS33-βcatenin$_{30-39}$(V) is more efficient than pS33-βcatenin$_{30-39}$ at inducing a pS33-βcatenin$_{30-39}$-specific immune response. This unique and unexpected combination of highly desirable attributes—enhanced MHC binding, enhanced immunogenicity, ability to elicit crossreactive high avidity pS33-βcat$_{30}$-specific T cells, as well as the melanoma tumor delaying ability of such cells—makes the pS33-βcat(V)$_{30}$ phosphopeptide particularly well suited for inclusion in a phosphopeptide composition vaccine against melanoma.

Tensin 3 (TNS3; Tensin-3) plays a role in actin remodeling. It is involved in the dissociation of the integrin-tensin-actin complex. Epidermal growth factor (EGF) activates Tensin 4 (TNS4; Tensin-4) and down-regulates TNS3, which results in capping the tail of integrin β1 (ITGB1). TNS3 also seems to be involved in mammary cell migration, and might be involved in cell migration and bone development. The TNS3 phosphopeptide VMIGsPKKL (SEQ ID NO: 426) of the presently disclosed subject matter has been determined to have weak MHC binding affinity. However, it was surprisingly discovered that notwithstanding this weak binding affinity, it is nevertheless capable of capable of inducing a strong phosphopeptide-specific memory T cell response in a patient. This further supports the position that peptide/MHC binding affinity does not correlate with the ability of a phosphopeptide to induce a phosphopeptide-specific immune response.

The breast cancer anti-estrogen resistance 3 (BCAR3) polypeptide activates the PI3K/Akt pathway and mediates migration and estrogen resistance in breast cancer cells, processes that are associated with malignancy. In contrast to the results with the pS33-βcatenin$_{30-39}$ peptide, substitution of the P9 residue Leu with Val (i.e., SEQ ID NO: 398 vs. 2001, the latter of which is referred to herein as "modified BCAR3pT130") had no impact on HLA-A2 binding affinity.

The modified BCAR3pT130 is nevertheless, significantly immunogenic. This suggests that the modification altered the conformation of the phosphopeptide and that the immune response against the natural phosphopeptide is restricted by tolerance. CD8$^+$ T cells generated using the modified BCAR3pT130 produced IFNγ, TNFα, and were cytotoxic based on CD107a expression. Importantly, the T cells were equally reactive with the natural and modified phosphopeptides. This suggests that the natural BCAR3pT130 (i.e., SEQ ID NO: 398) phosphopeptide is an agonist and that the sequence modification creates a stronger agonist. These T cells also recognized endogenously processed BCAR3pT130 on HLA-A2 human melanoma and breast cancer cells.

Insulin receptor substrate 2 (IRS-2) overexpression, either at the gene or protein level, is evident in many different cancer types and has been demonstrated to cause mammary tumorigenesis and enhanced metastasis in vivo. IRS proteins are adapter proteins that link signaling from upstream activators to multiple downstream effectors to modulate normal growth, metabolism, survival, and differentiation. It is disclosed herein that phosphorylated IRS-2 is broadly displayed on multiple cancer types and the resulting phosphopeptide is endogenously processed and presented at levels that allow strong immune responses to be generated against it. Phosphopeptide-specific CD8$^+$ T cells can be generated from HLA-A2 transgenic mice upon immunization with the pIRS2 phosphopeptide, and these T cells are capable of recognizing and killing human melanoma and breast tumors in vitro and controlling tumor growth in a xenograft tumor model system.

Cell division cycle 25 (CDC25) is a dual-specificity phosphatase first isolated from the yeast *Schizosaccharomyces pombe* as a cell cycle defective mutant. Dual-specificity phosphatases are considered a subclass of protein tyrosine phosphatases. By removing inhibitory phosphate residues from target cyclin-dependent kinases (Cdks), CDC25 proteins control entry into and progression through various phases of the cell cycle, including mitosis and S-phase. The structure of the CDC25 proteins can be divided into two main regions: the N-terminal region, which is highly divergent and contains sites for its phosphorylation and ubiquitination that regulate the phosphatase activity; and the C-terminal region, which is highly homologous and contains the catalytic site. The CDC25s, and in particular CDC25A and CDC25B, are proto-oncogenes in humans and have been shown to be overexpressed in a number of cancers. In some embodiments, the phosphopeptide compositions of the presently disclosed subject matter include the phosphopeptide GLLGpSPVRA (SEQ ID NO: 396).

In some embodiments, the target peptides are combined into compositions that can be used in vaccine compositions for eliciting anti-tumor immune responses and/or in adoptive T cell therapy of cancer patients including, but not limited to melanoma patients. Tables 9-16 list exemplary phosphopeptides that are presented on the surface of cancer cells. Exemplary variants and mimetics of these peptides and of additional class I MHC phosphopeptides are also provided, for example, in Tables 17 and 18.

II.C. Immunosuitablity

Although individuals in the human population display hundreds of different HLA alleles, some are more prevalent than others. For example, 88% of melanoma patients carry at least one of the six HLA alleles: HLA-A*0201 (51%), HLA-A*0101 (29%), HLA-A*0301 (21%), HLA-B*4402 (27%), HLA-B*0702 (30%), and HLA-B*-2705 (7%).

The presently disclosed subject matter provides in some embodiments target peptides which are immunologically suitable for each of the foregoing HLA alleles. "Immunologically suitable" means that a target peptide will bind at least one allele of an MHC class I molecule in a given patient. Compositions of the presently disclosed subject matter are in some embodiments immunologically suitable for a patient when at least one target peptide of the composition will bind at least one allele of an MHC class I molecule in a given patient. Compositions of multiple target peptides presented by each of the most prevalent alleles used in a cocktail ensures coverage of the human population and to minimize the possibility that the tumor will be able to escape immune surveillance by down-regulating expression of any one class I target peptide.

The compositions of the presently disclosed subject matter can in some embodiments comprise at least one target peptide specific for one or more of the following alleles: HLA-A*0201, HLA-A*0101, HLA-A*0301, HLA-B*4402, HLA-B*0702, HLA-B*-2705, and HLA-B*1402. The compositions of the presently disclosed subject matter can in some embodiments have at least one target peptide specific for one or more of the following alleles HLA-A*0201, HLA-A*0101, HLA-A*0301, HLA-B*4402, and HLA-B*0702. Alternatively, the compositions of the presently disclosed subject matter can in some embodiments have at least one target peptide specific for HLA-A*0201, HLA-A*0101, HLA-A*0301, HLA-B*4402, HLA-B*0702, HLA-B*-2705, HLA-B*1402, or any combination thereof. The compositions may have at least one phosphopeptide specific for about or at least 1, 2, 3, 4, 5, or all 6 of the aforementioned alleles.

As such, the compositions of the presently disclosed subject matter containing various combinations of target peptides are in some embodiments immunologically suitable for between or about 3-88%, 80-89%, 70-79%, 60-69%, 57-59%, 55-57%, 53-55% or 51-53% or 5-90%, 10-80%, 15-75%, 20-70%, 25-65%, 30-60%, 35-55% or 40-50% of the population of a particular cancer including, but not limited to melanoma and/or leukemia. In some embodiments, the compositions of the presently disclosed subject matter are able to act as vaccine compositions for eliciting anti-tumor immune responses and/or in adoptive T cell therapy of melanoma patients wherein the compositions are immunologically suitable for about or at least 88, 87, 86, 85, 84, 83, 82, 81, 80, 79, 78, 77, 76, 75, 74, 73, 72, 71, 70, 69, 68, 67, 66, 65, 64, 63, 62, 61, 60, 59, 58, 57, 56, 55, 54, 53, 52, 51, 50, 49, 48, 47, 46, 45, 44, 43, 42, 41, 40, 39, 38, 37, 36, 35, 34, 33, 32, 31, 30, 29, 28, 27, 26, 25, 24, 23, 22, 20, 19, 18, 17, 16, 15, 14, 13, 12, 11, 10, 9, 8, 7, 6, 5, 4, or 3 percent of cancer such as, but not limited to melanoma patients.

III. Compositions

The phrase "target peptide compositions" as used herein refers to at least one target peptide formulated, for example, as a vaccine; or as a preparation for pulsing cells in a manner such that the pulsed cells, e.g., dendritic cells, will display the at least one target peptide in the composition on their surface, e.g., to T cells in the context of adoptive T cell therapy.

The compositions of the presently disclosed subject matter can in some embodiments include about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 50-55, 55-65, 65-80, 80-120, 90-150, 100-175, or 175-250 different target peptides.

The compositions of the presently disclosed subject matter in some embodiments generally include MHC class I specific target peptide(s) but can also include one or more target peptides specific for MHC class II, such as but not limited to the peptides set forth in Tables 21-22, or other peptides associated with tumors (e.g., tumor associated antigen ("TAA")) such as, but not limited to those disclosed in Table 2.

Compositions comprising the target peptide are typically substantially free of other human proteins or peptides. They can be made synthetically or by purification from a biological source. They can be made recombinantly. Desirably they are in some embodiments at least 90% pure, in some embodiments at least 92% pure, in some embodiments at least 93% pure, in some embodiments at least 94% pure, in some embodiments at least 95% pure, in some embodiments at least 96% pure, in some embodiments at least 97% pure, in some embodiments at least 98% pure, and in some embodiments at least 99% pure. For administration to a human, they generally do not contain other components that might be harmful to a human recipient (referred to herein as "pharmaceutically acceptable for use in a human"). The compositions are typically devoid of cells, both human and recombinant producing cells. However, as noted below, in some cases, it can be desirable to load dendritic cells with a target peptide and use those loaded dendritic cells as either an immunotherapy agent themselves or as a reagent to stimulate a patient's T cells ex vivo. The stimulated T cells can be used as an immunotherapy agent.

In some cases, it can be desirable to form a complex between a target peptide and an HLA molecule of the appropriate type. Such complexes can be formed in vitro or in vivo. Such complexes are in some embodiments tetrameric with respect to an HLA-target peptide complex.

Under certain circumstances it can be desirable to add additional proteins or peptides, for example, to make a cocktail having the ability to stimulate an immune response in a number of different HLA type hosts. Alternatively, additional proteins and/or peptides can provide an interacting function within a single host, such as but not limited to an adjuvant function or a stabilizing function. As a non-limiting example, other tumor antigens can be used in admixture with the target peptides such that multiple different immune responses are induced in a single patient.

Administration of target peptides to a mammalian recipient can be accomplished using long target peptides (e.g., longer than 15 residues), and/or using target peptide-loaded dendritic cells. See Melief, 2009. In some embodiments, an immediate goal of the administration of target peptides is to induce activation of $CD8^+$ T cells in a subject. Additional components that can be administered to the same subject, either at the same time and/or close in time (such as but not limited to within 3, 5, 7, 10, 14, 17, or 21 days of each other, or even longer) include TLR-ligand oligonucleotide CpG and related target peptides that have overlapping sequences of at least six amino acid residues. To ensure efficacy, mammalian recipients should express the appropriate human HLA molecules to bind to the target peptides. Transgenic mammals can be used as recipients, for example, if they express appropriate human HLA molecules. If a mammal's own immune system recognizes a similar target peptide then it can be used as model system directly without introducing a transgene. Useful models and recipients can be at increased risk of developing metastatic cancer, such as metastatic melanoma. Other useful models and recipients can be predisposed, e.g., genetically and/or environmentally, to develop melanoma or other cancer.

III.A. Selection of Target Peptides

Disclosed herein is the finding that immune responses can be generated against phosphorylated peptides tested in healthy and diseased individuals. The T cells associated with these immune responses, when expanded in vitro, are able to recognize and kill malignant tissue (both established cells lines and primary tumor samples). Cold-target inhibition studies reveal that these target peptide-specific T cell lines kill primary tumor tissue in a target peptide-specific manner.

When selecting target peptides of the presently disclosed subject matter for inclusion in immunotherapy, e.g., in adaptive cell therapy or in the context of a vaccine, one can in some embodiments pick target peptides using one or more of the following criteria: 1) peptides associated with a particular cancer/tumor cell type; 2) a peptide derived from a gene product (e.g., a polypeptide) associated with cell proliferation, transformation, and/or malignancy; 3) a peptide that is specific for an HLA allele carried the group of patients to be treated; and/or 4) a peptide that is capable of inducing a target peptide-specific memory T cell response in the patients to be treated upon a first exposure to a composition including the selected target peptides.

III.B. Target Peptide Vaccines

The antigen target peptides can also be employed in a composition designed to vaccinate an individual. The antigen target peptides can in some embodiments be injected alone and can in some embodiments be administered in combination with an adjuvant and/or a pharmaceutically acceptable carrier. Vaccines are envisioned to prevent and/or treat certain diseases in general, and cancers in particular.

The target peptide-containing compositions of the presently disclosed subject matter can in some embodiments be used as a vaccine for cancer, and more specifically for melanoma, leukemia, ovarian, breast, colorectal, or lung squamous cancer, sarcoma, renal cell carcinoma, pancreatic carcinomas, squamous tumors of the head and neck, brain cancer, liver cancer, prostate cancer, ovarian cancer, and cervical cancer. The compositions can include target peptides. The vaccine compositions can in some embodiments include only the target peptides, or peptides disclosed herein, or they can include other cancer antigens that have been identified.

The vaccine compositions of the presently disclosed subject matter can be used prophylactically for the purposes of preventing, reducing the risk of, and/or delaying initiation of a cancer in an individual that does not currently have cancer. Alternatively, they can be used to treat an individual that already has cancer, so that recurrence or metastasis is delayed and/or prevented. Prevention relates to a process of prophylaxis in which the individual is immunized prior to the induction or onset of cancer. For example, in some embodiments individuals with a history of severe sunburn and at risk for developing melanoma can be immunized prior to the onset of the disease.

Alternatively, individuals that already have cancer can be immunized with the target peptide-containing compositions of the presently disclosed subject matter so as to stimulate an immune response that would be reactive against the cancer. A clinically relevant immune response would be one in which the cancer partially or completely regresses and is eliminated from the patient, and it would also include those responses in which the progression of the cancer is blocked without being eliminated. Similarly, prevention need not be total, but may result in a reduced risk, delayed onset, or delayed progression or metastasis.

In some embodiments, the vaccines of the presently disclosed subject matter can be used to treat malignant melanoma. Malignant melanomas usually present at two extremes: at one end of the spectrum are patients with small skin lesions that may be curable by surgical resection and at the other are patients with widely metastatic disease, in whom the therapeutic options are limited and the prognosis is poor: e.g., with a median survival of only 6 to 9 months. Prognosis also is related to the type of melanoma. Generally, patents with Stage I disease have 5-year survival rate of greater than or about 90%. Patients with Stage II disease have 5-year survival rate ranging from about 45 to about 77%, Patients with Stage III disease have 5-year survival rate ranging from about 27 to about 70%. Patients with metastatic disease have a 5-year survival rate of less than or about 20%. Various Stages and Substages of melanoma can be summarized as follows:

Stage IA: Lesions less than or equal to 1 mm thick with no evidence of ulceration or metastases (T1aN0M0) are associated with a 5-year survival rate of 95%.

Stage IB: Lesions less than or equal to or about 1 mm thick with ulceration noted but without lymph node involvement (T1bN0M0) or lesions 1.01-2 mm thick without ulceration or lymph node involvement (T2aN0M0) are associated with a 5-year survival rate of approximately 91%.

Stage IIA: Melanomas greater than 1 mm but less than or about 2.01 mm in thickness with no evidence of metastases but with evidence of ulceration (T2bN0M0) or lesions 2.01-4.0 mm without ulceration or lymph node involvement (T3aN0M0) are associated with an overall 5-year survival rate of 77-79%.

Stage IIB: Melanomas 2.01-4 mm thick with ulceration but no lymph node involvement (T3bN0M0) or lesions greater than 4 mm without ulceration or lymph node involvement (T4aN0M0) are associated with a 5-year survival rate of 63-67%.

Stage IIC: Lesions greater than 4 mm with ulceration but no lymph node involvement (T4bN0M0) are associated with a 5-year survival rate of 45%.

Stage IIIA: Patients with any depth lesion, no ulceration and 1 positive (micrometastatic) lymph node (T1-4a, N1a, M0) have a 5-year survival rate of 70%. T1-4a, N2a, M0 lesions (any depth lesion, no ulceration but 2-3 nodes positive for micrometastasis) are associated with a 5-year survival rate of 63%.

Stage IIIB: Patients with any depth lesion, positive ulceration, and 1 lymph node positive for micrometastasis (T1-4b, N1a, M0) or 2-3 nodes positive for micrometastasis (T1-4b, N2a, M0) have a 5-year survival rate of 50-53%. Patients with any depth lesion, no ulceration, and 1 lymph node positive for macrometastasis (T1-4a, N1b, M0) or 2-3 nodes positive for macrometastasis (T1-4a, N2b, M0) have a 5-year survival rate of 46-59%.

Stage IIIC: Patients with any depth lesion, positive ulceration, and 1 lymph node positive for macrometastasis (T1-4b, N1b, M0) or 2-3 nodes positive for macrometastasis (T1-4b, N2b, M0) or 4 or more metastatic lymph nodes, matted lymph nodes, or in transit met(s)/satellite(s) have a 5-year survival rate of 24-29%.

Stage IV: Melanoma metastatic to skin, subcutaneous tissue, or lymph nodes with normal LDH (M1a) is associated with a 5-year survival rate of 19%. M1b disease (metastatic disease to lungs with normal LDH) has a 5-year survival rate of 7%. M1c disease (metastatic disease to all other visceral organs and normal LDH or any distant disease with elevated LDH) is associated with a 5-year survival rate of 10%.

The target peptide vaccines of the presently disclosed subject matter can in some embodiments be given to patients before, after, or during any of the aforementioned stages of melanoma. In some embodiments, they are given to patients with Stage IV melanoma.

In some embodiments, the 5-year survival rate of patients treated with the vaccines of the presently disclosed subject matter is increased by a statistically significant amount: e.g., by about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 percent, or even greater than 100 percent, relative to the average 5-year survival rates described above.

In some embodiments, the target peptide vaccine compositions of the presently disclosed subject matter increase survival rates in patients with metastatic melanoma by a statistically significant amount of time such as, but not limited to by about or at least 0.25, 0.5, 0.75, 1.0, 1.25, 1.5, 1.75, 2.0, 2.25, 2.5, 2.75, 3.0, 3.25, 3.5, 4.0, 4.25, 4.5, 4.75, 5.0, 5.25, 5.5, 5.75, 6.0, 6.25, 6.5, 6.75, 7.0, 7.25, 7.5, 7.75, 8.0, 8.25, 8.5, 8.75, 9.0, 9.25, 9.50, 9.75, 10.0, 10.25, 10.5, 10.75, 11.0, 11.25, 11.5, 11.75, or 12 months or more compared to what could have been expected without vaccine treatment at the time of filing of this specification.

In some embodiments, the survival rate (e.g., the 1, 2, 3, 4, or 5-year survival rate) of patients treated with the vaccines of the presently disclosed subject matter is increased by a statistically significant amount such as, but not limited to about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 percent, or even greater than 100 percent, relative to the average 5-year survival rates described above.

The target peptide vaccines of the presently disclosed subject matter are in some embodiments envisioned to illicit a T cell-associated immune response such as, but not limited to generating activated $CD8^+$ T cells specific for native target peptide/MHC class I expressing cells. In some embodiments, the $CD8^+$ T cells specific for native target peptide/MHC class I expressing cells are specific for at least or about 1, 2, 3, 4, 5, 6, 7, 8, 9, 10, or more of the target peptides in the vaccine in a patient for about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 or more days after providing the vaccine to the patient.

In some embodiments, the treatment response rates of patients treated with the target peptide vaccines of the presently disclosed subject matter are increased by a statistically significant amount such as, but not limited to about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 07, 98, 99, 100, 150, 200, 250, 300, 350, 400, 450, or 500 or more percent, relative to treatment without the vaccine.

In some embodiments, overall median survival of patients treated with the target peptide vaccines of the presently disclosed subject matter is increased by a statistically significant amount such as, but not limited to about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 150, 200, 250, 300, 350, 400, 450, or 500 or more percent, relative to treatment without the vaccine. In some embodiments, the overall median survival of Stage IV melanoma patients treated the target peptide vaccines is envisioned to be about or at least 10.0, 10.25, 10.5, 10.75, 11.0, 11.25, 11.5, 11.75, 12, 12.25, 12.5, 12.75, 13, 13.25, 13.5, 13.75, 14, 14.25, 14.5, 14.75, 15, 16, 17, 18, 19, 20, 21, 22, 23, 24, 25, 26, 27, 28, 29, 30, 31, 32, 33, 34, 35, 36 or more months.

In some embodiments, tumor size of patients treated with the target peptide vaccines of the presently disclosed subject matter is decreased by a statistically statistically significant amount such as, but not limited to about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 150, 200, 250, 300, 350, 400, 450, or 500 or more percent, relative to treatment without the vaccine.

In some embodiments, the compositions of the presently disclosed subject matter provide a clinical tumor regression that is by a statistically significant amount such as, but not limited to about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of patients treated with the composition.

In some embodiments, the compositions of the presently disclosed subject matter provide a CTL response specific for the cancer being treated, e.g., melanoma, by a statistically significant amount such as, but not limited to about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 percent of patients treated with the composition.

In some embodiments, the compositions of the presently disclosed subject matter provide an increase in progression free survival in the cancer being treated, such as but not limited to melanoma, of about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 225, 250, 275, 300, 325, 350, 375, 400, 425, 450, 475, 500 or more months compared to the progression free survival or patients not treated with the composition.

In some embodiments, one or more of progression free survival, CTL response rates, clinical tumor regression rates, tumor size, survival rates (such as but not limited to overall survival rates), and/or response rates are determined, assessed, calculated, and/or estimated weekly, monthly, bi-monthly, quarterly, semi-annually, annually, and/or bi-annually over a period of about or at least 1, 2, 3, 4, 5, 6, 7, 8, 9, 10, 11, 12, 13, 14, 15 or more years or about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 120, 130, 140, 150, 160, 170, 180, 190, 200, 225, 250, 275, 300, 325, 350, 375, 400, 425, 450, 475, 500 or more weeks.

III.C. Compositions for Priming T Cells

Adoptive cell transfer (ACT) is the passive transfer of cells, in some embodiments immune-derived cells, into a recipient host with the goal of transferring the immunologic functionality and characteristics into the host. Clinically, this approach has been exploited to transfer either immune-promoting or tolergenic cells (often lymphocytes) to patients to enhance immunity against cancer. The adoptive transfer of autologous tumor infiltrating lymphocytes (TIL) or genetically redirected peripheral blood mononuclear cells has been used to successfully treat patients with advanced solid tumors, including melanoma and colorectal carcinoma, as well as patients with CD19-expressing hematologic malignancies. In some embodiments, ACT therapies achieve T cell stimulation ex vivo by activating and expanding autologous tumor-reactive T cell populations to large numbers of cells that are then transferred back to the patient. See Gattinoni et al., 2006.

The target peptides of the presently disclosed subject matter can in some embodiments take the form of antigenic peptides formulated in a composition added to autologous dendritic cells and used to stimulate a T helper cell or CTL response in vitro. The in vitro generated T helper cells or CTL can then be infused into a patient with cancer (Yee et al., 2002), and specifically a patient with a form of cancer that expresses one or more of antigenic target peptides.

Alternatively, the target peptides can be added to dendritic cells (DCs) in vitro to produce loaded DCs, with the loaded DCs being subsequently transferred into an individual with cancer in order to stimulate an immune response. Alternatively, the loaded DCs can be used to stimulate CD8$^+$ T cells ex vivo with subsequent reintroduction of the stimulated T cells to the patient. Although a particular target peptide might be identified on one particular cancer cell type, it might also be found on other cancer cell types.

The presently disclosed subject matter envisions treating cancer by providing a patient with cells pulsed with a composition of target peptides. The use of DCs pulsed with target peptides peptide antigens enables manipulation of the immunogen in two ways: varying the number of cells injected and varying the density of antigen presented on each cell. Exemplary non-limiting methods for DC-based based treatments can be found, for example in Mackensen et al., 2000.

III.D. Additional Peptides Present in Target Peptide Compositions

The target peptide compositions (or target peptide composition kits comprising the same) of the presently disclosed subject matter can in some embodiments also include at least one additional peptide derived from one or more tumor-associated antigens (TAAs). Examples of TAAs include MelanA (MART-I), gp100 (Pmel 17), tyrosinase, TRP-1, TRP-2, MAGE-1, MAGE-3, BAGE, GAGE-1, GAGE-2, p15(58), CEA, RAGE, NY-ESO (LAGE), SCP-1, Hom/Mel-40, PRAME, p53, H-Ras, HER-2/neu, BCR-ABL, E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, β-Catenin, CDK4, Mum-1, p16, TAGE, PSMA, PSCA, CT7, telomerase, 43-9F, 5T4, 791Tgp72, alpha-fetoprotein, β-HCG, BCA225, BTAA, CA 125, CA 15-3 (CA 27.29\BCAA), CA 195, CA 242, CA-50, CAM43, CD68\KP1, CO-029, FGF-5, G250, Ga733 (EpCAM), HTgp-175, M344, MA-50, MG7-Ag, MOV18, NB/70K, NY-CO-1, RCAS1, SDCCAG16, TA-90 (Mac-2 binding protein/cyclophilin C-associated protein), TAAL6, TAG72, TLP, TPS, prostatic acid phosphatase, and the like. Exemplary, non-limiting peptides derived from TAAs that can be incorporated into target peptide compositions (or target peptide composition kits comprising the same) of the presently disclosed subject matter are presented in Table 2.

TABLE 2

Exemplary Tumor-associated Antigen Peptides

| Tumor-associated Antigen[1] | Peptide Sequence |
| --- | --- |
| gp100$_{280-288}$ | YLEPGPVTA (SEQ ID NO: 2168) |
| Tyr$_{369-377}$ | DYMDGTMSQV (SEQ ID NO: 2169) |
| gp100$_{17-25}$ | ALLAVGATK (SEQ ID NO: 2170) |
| Tyr$_{243-251}$ | KCDICTDEY (SEQ ID NO: 2171) |
| TAG-1, 2 | RLSNRLLLR (SEQ ID NO: 2172) |
|  | SQNFPGSQK (SEQ ID NO: 2173) |
| gp100$_{154-162}$ | KTWGQYWQV (SEQ ID NO: 2174) |
| gp100$_{209-217}$ | I(T/M)DQVPFSV (SEQ ID NO: 2175) |
| gp100$_{476-485}$ | VLYRYGSFSV (SEQ ID NO: 2176) |
| MART-1/MelanA$_{27-35}$ | AAGIGILTV (SEQ ID NO: 2177) |
| gp100 | ALNFPGSQK (SEQ ID NO: 2178) |
| gp100$_{614-622}$ | LIYRRRLMK (SEQ ID NO: 2179) |
| NY-ESO-1 | AAQERRVPR (SEQ ID NO: 2180) |

TABLE 2-continued

Exemplary Tumor-associated Antigen Peptides

| Tumor-associated Antigen[1] | Peptide Sequence |
|---|---|
| NY-ESO-1 | ASGPGGGAPR (SEQ ID NO: 2181) |
| NY-ESO-1 | LLGPGRPYR (SEQ ID NO: 2182) |
| $Tyr_{240-251}$ | SDAEKSDICTDEY (SEQ ID NO: 2183) |
| $Tyr_{146-156}$ | SSDYVIPIGTY (SEQ ID NO: 2184) |
| $MAGE-A1_{161-169}$ | EADPTGHSY (SEQ ID NO: 2185) |
| $MAGE-A3_{168-176}$ | EVDPIGHLY (SEQ ID NO: 2186) |
| $Tyr_{369-377}$ | DYMDGTMSQV (SEQ ID NO: 2187) |
| $gp100_{209-217}$ | IMDQVPFSV (SEQ ID NO: 2188) |
| $gp100_{280-288}$ | YLEPGPVTA (SEQ ID NO: 2189) |
| $MAGE-A10_{254-262}$ | GLYDGMEHL (SEQ ID NO: 2190) |
| $gp100_{614-622}$ | LIYRRRLMK (SEQ ID NO: 2191) |
| $NY-ESO-1_{53-6}$ | ASGPGGGAPR (SEQ ID NO: 2192) |
| $Tyr_{56-70}$ | AQNILLSNAPLGPQFP (SEQ ID NO: 2193) |
| $Tyr_{388-406}$ | FLLHHAFVDSIFEQWLQRHRP (SEQ ID NO: 2194) |
| $Melan-A/MART-1_{51-73}$ | RNGYRALMDKSLHVGTQCALTRR (SEQ ID NO: 2195) |
| $MAGE-A3_{281-295}$ | TSYVKVLHHMVKISG (SEQ ID NO: 2196) |
| $MAGE-A1, 2, 3, 6_{121-134}$ | LLKYRAREPVTKAE (SEQ ID NO: 2197) |
| $Gp100_{44-59}$ | WNRQLYPEWTEAQRLD (SEQ ID NO: 2198) |
| $P2_{830-844}$ | AQYIKANSKFIGITEL (SEQ ID NO: 2199) |
| $Her2/neu_{369-377}$ | KIFGSLAFL (SEQ ID NO: 2200) |
| $CEA_{571-579}$ | YLSGADLNL (SEQ ID NO: 2201) |
| $Her2/neu_{754-762}$ | VLRENTSPK (SEQ ID NO: 2202) |
| $MAGE-A1_{161-169}$ | EADPTGHSY (SEQ ID NO: 2203) |
| FBP191-199 | EIWTHSYKV (SEQ ID NO: 2204) |
| $MAGE-A1_{96-104}$ | SLFRAVITK (SEQ ID NO: 2205) |
| $MAGE-A3_{168-176}$ | EVDPIGHLY (SEQ ID NO: 2206) |
| $MAGE-A10_{254-262}$ | GLYDGMEHL (SEQ ID NO: 2207) |
| $CEA_{27-35}$ | HLFGYSWYK (SEQ ID NO: 2208) |
| $NY-ESO-1_{53-62}$ | ASGPGGGAPR (SEQ ID NO: 2209) |
| $MART-1_{97-116}$ | APPAYEKLS (SEQ ID NO: 2210) |
| $MART-1_{98-109}$ | PPAYEKLSA (SEQ ID NO: 2211) |
| $MART-1_{99-110}$ | PAYEKLSAE (SEQ ID NO: 2212) |
| $MART-1_{97-116}$ | VPNAPPAYEKLpSAEQSPPPY (SEQ ID NO: 2213) |
| $MART-1_{98-109}$ | PNAPPAYEKLpSA (SEQ ID NO: 2214) |
| $MART-1_{99-110}$ | NAPPAYEKLpSAE (SEQ ID NO: 2215) |
| $MART-1_{100-111}$ | APPAYEKLpSAEQ (SEQ ID NO: 2216) |
| $MART-1_{100-114}$ | APPAYEKLpSAEQSPP (SEQ ID NO: 2217) |
| $MART-1_{100-115}$ | APPAYEKLpSAEQSPPP (SEQ ID NO: 2218) |

TABLE 2-continued

Exemplary Tumor-associated Antigen Peptides

| Tumor-associated Antigen[1] | Peptide Sequence |
|---|---|
| MART-1$_{100-116}$ | APPAYEKLpSAEQSPPP (SEQ ID NO: 2219) |
| MART-1$_{101-112}$ | PPAYEKLpSAEQS (SEQ ID NO: 2220) |
| MART-1$_{102-113}$ | PAYEKLpSAEQSP (SEQ ID NO: 2221) |
| MART-1$_{103-114}$ | AYEKLpSAEQSPP (SEQ ID NO: 2222) |
| MART-1$_{104-115}$ | YEKLSAEQSPPP (SEQ ID NO: 2223) |
| MART-1$_{100-111}$ | APPAYEKLpSAEQ (SEQ ID NO: 2224) |
| MART-1$_{100-114}$ | APPAYEKLpSAEQSPP (SEQ ID NO: 2225) |
| MART-1$_{100-115}$ | APPAYEKLSAEQSPPP (SEQ ID NO: 2226) |

[1]the numbers listed in lowercase denote the amino acid positions of the peptide sequences for each TAA Such tumor-specific peptides can be added to the target peptide compositions in a manner, number, and in an amount as if they were an additional target peptide added to the target peptide compositions as described herein.

In some embodiments, the tumor-specific peptides added to the target peptide compositions of the presently disclosed subject matter comprise, consist essentially of, or consist of the amino acid sequences SDAEKSDICTDEY (SEQ ID NO: 2183), SSDYVIPIGTY (SEQ ID NO: 2184), EADPTGHSY (SEQ ID NO: 2185), EVDPIGHLY (SEQ ID NO: 2186), YMDGTMSQV (SEQ ID NO: 2187), IMDQVPFSV (SEQ ID NO: 2188), YLEPGPVTA (SEQ ID NO: 2189), GLYDGMEHL (SEQ ID NO: 2190), ALLAVGATK (SEQ ID NO: 2170), LIYRRRLMK (SEQ ID NO: 2179), SLFRAVITK (SEQ ID NO: 2205), ASGPGGGAPR (SEQ ID NO: 2192), or any combinations thereof.

III.E. Combination Therapies

In some embodiments, the target peptide compositions (or target peptide composition kits) of the presently disclosed subject matter are administered as a vaccine or in the form of pulsed cells as first, second, third, or fourth line treatment for the cancer. In some embodiments, the compositions of the presently disclosed subject matter are administered to a patient in combination with one or more therapeutic agents. Exemplary, non-limiting therapeutic agents include anti-Programed Death-1 (PD1) or PD1-antagonists such as the anti-PD1 antibody BMS-936558 (Bristol-Myers Squibb Co., New York, N.Y., United States of America); anti-CTLA-4 or CTLA-4 antagonists; vermurafenib; ipilimumab; Dacarbazine; IL-2; Temozolomide; receptor tyrosine kinase inhibitors, including but not limited to imatinib, gefitinib, erlotinib, sunitinib, tyrphostins, telatinib; sipileucel-T; a platinum-based agent; a taxane; an alkylating agent; an antimetabolite and/or a vinca alkaloid; and combinations thereof.

In some embodiments, the cancer is sensitive to and/or refractory, relapsed, and/or resistant to one or more chemotherapeutic agents such as, but not limited to a platinum-based agent, a taxane, an alkylating agent, an anthracycline (e.g., doxorubicin including but not limited to liposomal doxorubicin), an antimetabolite, and/or a vinca alkaloid. In some embodiments, the cancer is an ovarian cancer, and the ovarian cancer is refractory, relapsed, or resistant to a platinum-based agent (e.g., carboplatin, cisplatin, oxaliplatin), a taxane (e.g., paclitaxel, docetaxel, larotaxel, cabazitaxel), and/or an anthracycline (e.g., doxorubicin including but not limited to liposomal doxorubicin). In some embodiments, the cancer is colorectal cancer, and the cancer is refractory, relapsed, or resistant to an antimetabolite (e.g., an antifolate (e.g., pemetrexed, floxuridine, raltitrexed) a pyrimidine analogue (e.g., capecitabine, cytarrabine, gemcitabine, 5FU)), and/or a platinum-based agent (e.g., carboplatin, cisplatin, oxaliplatin). In some embodiments, the cancer is lung cancer, and the cancer is refractory, relapsed, or resistant to a taxane (e.g., paclitaxel, docetaxel, larotaxel, cabazitaxel), a platinum-based agent (e.g., carboplatin, cisplatin, oxaliplatin), a vinca alkaloid (e.g., vinblastine, vincristine, vindesine, vinorelbine), a vascular endothelial growth factor (VEGF) pathway inhibitor, an epidermal growth factor (EGF) pathway inhibitor) and/or an antimetabolite (e.g., an antifolate incuding but note limited to pemetrexed, floxuridine, or raltitrexed), and a pyrimidine analogue (e.g., capecitabine, cytarrabine, gemcitabine, 5FU). In some embodiments, the cancer is breast cancer, and the cancer is refractory, relapsed, or resistant to a taxane (e.g., paclitaxel, docetaxel, larotaxel, cabazitaxel), a VEGF pathway inhibitor, an anthracycline (e.g., daunorubicin, doxorubicin including but not limited to liposomal doxorubicin, epirubicin, valrubicin, idarubicin), a platinum-based agent (e.g., carboplatin, cisplatin, oxaliplatin), and/or an antimetabolite (e.g., an antifolate including but not limited to pemetrexed, floxuridine, or raltitrexed), and a pyrimidine analogue (e.g., capecitabine, cytarrabine, gemcitabine, 5FU). In some embodiments, the cancer is gastric cancer, and the cancer is refractory, relapsed, or resistant to an antimetabolite (e.g., an antifolate including but not limited to pemetrexed, floxuridine, raltitrexed) and a pyrimidine analogue (e.g., capecitabine, cytarrabine, gemcitabine, 5FU) and/or a platinum-based agent (e.g., carboplatin, cisplatin, oxaliplatin).

Single-agent dacarbazine (DTIC) treatment in advanced-stage malignant melanoma generally yields only a 10-15% response rate. (Fecher & Flaherty, 2009). Two combination regimens commonly are used in the treatment of patients with advanced-stage melanoma. The first regimen is the cisplatin, vinblastine, and DTIC (CVD) regimen. The second commonly used regimen is the Dartmouth regimen, which is a combination of cisplatin, DTIC, carmustine, and tamoxifen. Among patients with advanced melanoma who had alternations in the type III transmembrane receptor tyrosine kinase KIT, treatment with imatinib mesylate resulted in clinically significant response in a subset of patients (Carvajal et al., 2011). DTIC was the first drug approved for the treatment of metastatic melanoma. In the initial studies with dacarbazine, the overall response rate was 22%, with no impact on survival. In a Phase III study of dacarbazine compared with temozolomide, the response rate was 12% versus 13% (Middleton et al., 2000). Carboplatin and paclitaxel have been tested in 2 small Phase II studies, and when used in combination with sorafenib, the response rate was 11-17%. In some embodiments, temozolomide is included in a first-line drug for melanoma.

In some embodiments, the target peptide compositions (or target peptide composition kits) of the presently disclosed subject matter are associated with agents that inhibit T cell apoptosis or anergy thus potentiating a T cell response (referred to herein as a "T cell potentiator"). Such agents include B7RP1 agonists, B7-H3 antagonists, B7-H4 antagonists, HVEM antagonists, HVEM antagonists, GAL9 antagonists or alternatively CD27 agonists, OX40 agonists, CD137 agonists, BTLA agonists, ICOS agonists CD28 agonists, or soluble versions of PDL1, PDL2, CD80, CD96, B7RP1, CD137L, OX40 or CD70. See Pardoll, 2012.

In some embodiments, the T cell potentiator is a PD1 antagonist. Programmed death 1 (PD1) is a key immune checkpoint receptor expressed by activated T cells, and it mediates immunosuppression. PD1 functions primarily in peripheral tissues, where T cells can encounter the immunosuppressive PD1 ligands PD-L1 (B7-H1) and PD-L2 (B7-DC), which are expressed by tumor cells, stromal cells, or both. In some embodiments, the anti-PD1 monoclonal antibody BMS-936558 (also known as MDX-1106 and ONO-4538; Bristol-Myers Squibb) is used. In some embodiments, the T cell potentiator (e.g., PD1 antagonist) is administered as an intravenous infusion at least or about every 1, 1.5, 2, 2.5, 3, 3.5, or 4 weeks of each 4, 5, 6, 7, 8, 9, or 10-week treatment cycle of about for at least 1, 2, 3, 4, 5, 6, 7, 8, 9, 10, 11, 12, 13, 14, 15, 16, 17, 18, 19, 20, or more cycles. Exemplary, non-limiting doses of the PD1 antagonists are in some embodiments exactly, about, or at least 0.1, 0.2, 0.3, 0.4, 0.5, 0.6, 0.7, 0.8, 0.9, 1, 2, 3, 4, 5, 6, 7, 8, 9, 10, 11, 12, 13, 14, 15, 16, 17, 18, 19, 20, or more mg/kg. See Brahmer et al., 2012.

The exemplary therapeutic agents listed herein above are envisioned to be administered at a concentration of in some embodiments about 1 to 100 mg/m$^2$, in some embodiments about 10 to 80 mg/m$^2$, and in some embodiments about 40 to 60 mg/m$^2$. Further exemplary dosages include, but are not limited to about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, or more mg/m$^2$. Alternatively, an exemplary dosage range can be in some embodiments about or at least 0.001 to 100 mg/kg, in some embodiments about or at least 0.1 to 1 mg/kg, and in some embodiments about or at least 0.01 to 10 mg/kg.

The target peptide compositions (or target peptide composition kits) of the presently disclosed subject matter can in some embodiments be co-administered with cytokines such as lymphokines, monokines, growth factors, and traditional polypeptide hormones. Exemplary cytokines are growth hormones including but not limited to human growth hormone, N-methionyl human growth hormone, and bovine growth hormone; parathyroid hormone; thyroxine; insulin; proinsulin; relaxin; prorelaxin; glycoprotein hormones including but not limited to follicle stimulating hormone (FSH), thyroid stimulating hormone (TSH), and luteinizing hormone (LH); hepatic growth factor; prostaglandin, fibroblast growth factor; prolactin; placental lactogen, OB protein; TNF-α and TNF-β; mullerian-inhibiting substance; mouse gonadotropin-associated peptide; inhibin; activin; VEGF; integrin; thrombopoietin (TPO); nerve growth factors including but not limited to NGF-β; platelet-growth factor; transforming growth factors (TGFs) including but not limited to TGF-α and TGF-β; insulin-like growth factor (IGF)-I and IGF-II; erythropoietin (EPO); osteoinductive factors; interferons (IFN) including but not limited to IFNα, IFNβ, and IFNγ; colony stimulating factors (CSFs) including but not limited to macrophage-CSF (M-CSF), granulocyte-macrophage-CSF (GM-CSF), and granulocyte-CSF (G-CSF); interleukins (ILs) including but not limited to IL-1, IL-1α, IL-2, IL-3, IL-4, IL-5, IL-6, IL-7, IL-8, IL-9, IL-10, IL-11, IL-12; IL-13, IL-14, IL-15, IL-16, IL-17, and IL-18; leukemia inhibitory factor (LIF), kit-ligand; FLT-3; angiostatin; thrombospondin; endostatin; and lymphotoxin (LT). As used herein, the term cytokine includes proteins from natural sources and/or from recombinant cell culture and biologically active equivalents thereof.

The target peptide compositions of the presently disclosed subject matter can in some embodiments be provided with administration of cytokines around the time of (including but not limited to about or at least 1, 2, 3, or 4 weeks or days before and/or after) the initial dose of a target peptide composition.

Exemplary non-limiting doses of the cytokine are in some embodiments about or at least 1-100, 10-80, 20-70, 30-60, 40-50, or 1, 2, 3, 4, 5, 6, 7, 8, 9 or 10 Mu/m$^2$/day over about or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, or 70 days. The cytokine can in some embodiments be delivered at least or about once every 1, 2, 3, 4, 5, 6, 7, 8, 9, 10, 11, 12, 13, 14, 15, 16, 17, 18, 19, 20, 21, 22, 23, or 24 hours. Cytokine treatment can be provided in at least or about 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30 cycles of at least or about 1, 2, 3, 4, 5, 6, 7, 8, 9, 10, or more weeks, wherein each cycle has at least or about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, or more cytokine doses. Cytokine treatment can in some embodiments be on the same schedule as administration of the target peptide compositions or in some embodiments on a different schedule, which differing schedule can in some embodiments be an overlapping schedule.

In some embodiments, the cytokine is IL-2 and is dosed in an amount about or at least 100,000 to 1,000,000; 200,000-900,000; 300,000-800,000; 450,000-750,000; 600,000-800,000; or 700,000-800,000 (in some embodiments. 720,000) units (IU)/kg administered, e.g., as a bolus, every 1, 2, 3, 4, 5, 6, 7, 8, 9, 10, 11, 12, 13, 14, 15, 16, 17, 18, 19, or 20 hours for 1, 2, 3, 4, 5, 6, 7, 8, 9, 10, 11, 12, 13, 14, or more days, in a cycle, for example.

IV. Types of Proliferative Disease

In some embodiments, the compositions of the presently disclosed subject matter are envisioned to be useful in the treatment of benign and/or malignant proliferative diseases. Excessive proliferation of cells and turnover of cellular matrix contribute significantly to the pathogenesis of several diseases including but not limited to cancer, atherosclerosis, rheumatoid arthritis, psoriasis, idiopathic pulmonary fibrosis, scleroderma and cirrhosis of the liver, ductal hyperplasia, lobular hyperplasia, papillomas, and others.

In some embodiments, the proliferative disease is cancer, including but not limited to breast cancer, colorectal cancer, squamous carcinoma of the lung, sarcoma, renal cell carcinoma, pancreatic carcinomas, squamous tumors of the head and neck, leukemia, brain cancer, liver cancer, prostate cancer, ovarian cancer, and cervical cancer. In some embodiments, the presently disclosed compositions and methods are used to treat melanoma, acute myelogenous leukemia (AML), acute lyphocytic leukemia (ALL), chronic lymphocytic lymphoma (CLL), chronic myelogenous leukemia (CML), breast cancer, renal cancer, pancreatic cancer, and/or ovarian cancer.

In some embodiments, the target peptide compositions of the presently disclosed subject matter can be used to treat melanoma. The melanoma can be in some embodiments Stage I, in some embodiments Stage II (including but not limited to Stages IIa and/or IIb), Stage III, Stage IV, metastatic, malignant, or recurrent melanoma. When metastatic, the melanoma is in some embodiments in the lung, bone, liver, or brain.

In some embodiments, the cancer is a cancer described herein. For example, the cancer can be a cancer of the bladder (including but not limited to accelerated and metastatic bladder cancer), breast (including but not limited to estrogen receptor positive breast cancer, estrogen receptor negative breast cancer, HER-2 positive breast cancer, HER-2 negative breast cancer, triple negative breast cancer, and inflammatory breast cancer), colon (including but not limited to colorectal cancer), kidney (including but not limited to renal cell carcinoma), liver, lung (including but not limited to small cell lung cancer and non-small cell lung cancer such as but not limited to adenocarcinoma, squamous cell carcinoma, bronchoalveolar carcinoma and large cell carcinoma), genitourinary tract cancer, including but not limited to ovary (such as but not limited to fallopian, endometrial, and peritoneal cancers), cervix, prostate, and testes, lymphatic system, rectum, larynx, pancreas (including but not limited to exocrine pancreatic carcinoma), stomach (including but not limited to gastroesophageal, upper gastric, and lower gastric cancers), gastrointestinal cancer (including but not limited to anal cancer), gall bladder, thyroid, lymphoma (including but not limited to Burkitt's, Hodgkin's, and non-Hodgkin's lymphoma), leukemia (including but not limited to acute myeloid leukemia), Ewing's sarcoma, nasoesophageal cancer, nasopharyngeal cancer, neural and glial cell cancers (including but not limited to glioblastoma multiforme), and head and neck cancers. Exemplary non-limiting cancers also include melanoma, breast cancer (including but not limited to metastatic or locally advanced breast cancer), prostate cancer (including but not limited to hormone refractory prostate cancer), renal cell carcinoma, lung cancer (including but not limited to small cell lung cancer and non-small cell lung cancer (including adenocarcinoma, squamous cell carcinoma, bronchoalveolar carcinoma, and large cell carcinoma), pancreatic cancer, gastric cancer (including but not limited to gastroesophageal, upper gastric, and/or lower gastric cancer), colorectal cancer, squamous cell cancer of the head and neck, ovarian cancer (including but not limited to advanced ovarian cancer, platinum-based agent-resistant, and/or relapsed ovarian cancer), lymphoma (including but not limited to Burkitt's, Hodgkin's, or non-Hodgkin's lymphoma), leukemia (including but not limited to acute myeloid leukemia), and gastrointestinal cancer.

V. Administration of Vaccine Compositions

V.A. Routes of Administration

The target peptide compositions of the presently disclosed subject matter can be administered parenterally, systemically, topically, or any combination thereof. By way of example and not limitation, composition injections can be performed by intravenous (i.v.) injection, subcutaneous (s.c.) injection, intradermal (i.d.) injection, intraperitoneal (i.p.) injection, and/or intramuscular (i.m.) injection. One or more such routes can be employed. Parenteral administration can be, for example, by bolus injection or by gradual perfusion over time. Alternatively or in addition, administration can be by the oral route.

In some embodiments, an injection is an intradermal (i.d.) injection. The target peptide compositions are in some embodiments suitable for administration of the peptides by any acceptable route such as but not limited to oral (enteral), nasal, ophthal, and transdermal. In some embodiments, the administration is subcutaneous, and in some embodiments the subcutaneous administration is by an infusion pump.

V.B. Formulations

Pharmaceutical carriers, diluents, and excipients are generally added to the target peptide compositions or (target peptide compositions kits) that are compatible with the active ingredients and acceptable for pharmaceutical use. Examples of such carriers include but are not limited to water, saline solutions, dextrose, and/or glycerol. Combinations of carriers can also be used.

The vaccine compositions of the presently disclosed subject matter can further incorporate additional substances to stabilize pH and/or to function as adjuvants, wetting agents, and/or emulsifying agents, which can serve to improve the effectiveness of the vaccine.

The target peptide compositions may include one or more adjuvants such as for example: montanide ISA-51 (Seppic Inc., Fiarfield, N.J., United States of America); QS-21 (Aquila Biopharmaceuticals, Inc., Framingham, Mass., United States of America); Arlacel A; oeleic acid; tetanus helper peptides (such as but not limited to QYIKANSKFIGITEL (SEQ ID NO: 2376) and/or AQYIKANSKFIGITEL (SEQ ID NO: 2377); GM-CSF; cyclophosamide; *bacillus* Calmette-Guérin (BCG); *Corynbacterium parvum*; levamisole, azimezone; isoprinisone; dinitrochlorobenezene (DNCB); keyhole limpet hemocyanin (KLH); Freunds adjuvant (complete and incomplete); mineral gels; aluminum hydroxide (Alum); lysolecithin; pluronic polyols; polyanions; peptides; oil emulsions; nucleic acids (such as but not limited to souble-stranded RNAs; dsRNA) dinitrophenol; diphtheria toxin (DT); toll-like receptor (TLR; such as but not limited to TLR3, TLR4, TLR7, TLR8, and/or TLR9) agonists (including but not limited to endotoxins such as lipopolysaccharide (LPS); monophosphoryl lipid A (MPL); and/or polyinosinic-polycytidylic acid (poly-ICLC/HILTONOL®; Oncovir, Inc., Washington, D.C., United States of America); IMO-2055; glucopyranosyl lipid A (GLA); QS-21 (a saponin extracted from the bark of the *Quillaja saponaria* tree, also known as the soap bark tree or Soapbark); resiquimod (a TLR7/8 agonist); CDX-1401 (a fusion protein consisting of a fully human monoclonal antibody with specificity for the dendritic cell receptor DEC-205 linked to the NY-ESO-1 tumor antigen); Juvaris' Cationic Lipid-DNA Complex; Vaxfectin; and combinations thereof.

Polyinosinic-Polycytidylic acid (Poly IC) is a double-stranded RNA (dsRNA) that acts as a TLR3 agonist. To increase half-life, it has been stabilized with polylysine and carboxymethylcellulose as poly-ICLC. It has been used to induce interferon in cancer patients, with intravenous doses up to 300 μg/kg. Like poly-IC, poly-ICLC is a TLR3 agonist. TLR3 is expressed in the early endosome of myeloid DC; thus poly-ICLC preferentially activates myeloid dendritic cells, thus favoring a Th1 cytotoxic T cell response. Poly-ICLC activates natural killer (NK) cells, induces cytolytic potential, and induces IFNγ from myeloid DC.

In some embodiments, an adjuvant is provided at about or at least 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, or 1000 μg per dose or per kg in each dose. In some embodiments, the adjuvant is provided in a dosage of at least or about 0.1, 0.2, 0.3, 0.40, 0.50, 0.60, 0.70, 0.80, 0.90, 0.100, 1.10, 1.20, 1.30, 1.40, 1.50, 1.60, 1.70, 1.80, 1.90, 2.00, 2.10, 2.20, 2.30, 2.40, 2.50, 2.60, 2.70, 2.80, 2.90, 3.00, 3.10, 3.20, 3.30, 3.40, 3.50, 3.60, 3.70, 3.80, 3.90, 4.00, 4.10, 4.20, 4.30, 4.40, 4.50, 4.60, 4.70, 4.80, 4.90, 5.00, 5.10, 5.20, 5.30, 5.40, 5.50, 5.60, 5.70, 5.80, 5.90, 6.00, 6.10, 6.20, 6.30, 6.40, 6.50, 6.60, 6.70, 6.80, 6.90, 7.00, 7.10, 7.20, 7.30, 7.40, 7.50, 7.60, 7.70, 7.80, 7.90, 8.00, 8.10, 8.20, 8.30, 8.40, 8.50, 8.60, 8.70, 8.80, 8.90, 9.00, 9.10, 9.20, 9.30, 9.40, 9.50, 9.60, 9.70, 9.80, 9.90, or 10.00 grams per dose or per kg in each dose. In some embodiments, the adjuvant is given at about or at least 10, 15, 20, 25, 50, 75, 100, 125, 150, 175, 150, 175, 200, 225, 250, 275, 300, 325, 350, 375, 400, 425, 450, 500, 525, 550, 575, 600, 625, 675, 700, 725, 750, 775, 800, 900, 1000, 1100, 1200, 1300, 1400, 1500, 1600, 1700, 1800, 1900, or 2000 endotoxin units ("EU") per dose. The target peptide compositions of the presently disclosed subject matter can in some embodiments be provided with an administration of cyclophosamide around the time (e.g., about or at least 1, 2, 3, or 4 weeks or days before and/or after) of the initial dose of a target peptide composition. Exemplary non-limiting doses of cyclophosamide are about or at least 100, 200, 300, 400, 500, 600, 700, 800, 900, or 1000 Mg/m$^2$/day over about or at least 1, 2, 3, 4, 5, 6, 7, 8, 9, or 10 days.

The compositions can comprise the target peptides in the free form and/or in the form of a pharmaceutically acceptable salt. As used herein, "a pharmaceutically acceptable salt" refers to a derivative of a disclosed target peptide wherein the target peptide is modified by making acid or base salts of the agent. For example, acid salts are prepared from the free base (typically wherein the neutral form of the drug has a neutral —NH$_2$ group) involving reaction with a suitable acid. Suitable acids for preparing acid salts include both organic acids such as but not limited to acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluenesulfonic acid, salicylic acid, and the like, as well as inorganic acids such as but not limited to hydrochloric acid, hydrobromic acid, sulfuric acid, nitric acid phosphoric acid, and the like. Conversely, basic salts of acid moieties that can be present on a target peptide are in some embodiments prepared using a pharmaceutically acceptable base such as but not limited to sodium hydroxide, potassium hydroxide, ammonium hydroxide, calcium hydroxide, trimmethylamine, and the like. By way of example and not limitation, the compositions can comprise target peptides as salts of acetic acid (acetates), ammonium, or hydrochloric acid (chlorides).

In some embodiments, a composition can include one or more sugars, sugar alcohols, amino acids such but not limited to glycine, arginine, glutamic acid, and/or others as framework formers. The sugars can be mono-, di-, or trisaccharides. These sugars can be used alone and/or in combination with sugar alcohols. Exemplary sugars include glucose, mannose, galactose, fructose, or sorbose as monosaccharides; sucrose, lactose, maltose, and trehalose as disaccharides; and raffinose as a trisaccharide. A sugar alcohol can be, for example, mannitose. In some embodiments, the composition comprises sucrose, lactose, maltose, trehalose, mannitol, and/or sorbitol. In some embodiments, the composition comprises mannitol.

Furthermore, in some embodiments compositions can include physiological well-tolerated excipients (see *Handbook of Pharmaceutical Excipients*, 5$^{th}$ ed., edited by Raymond Rowe, Paul Sheskey and Sian Owen, Pharmaceutical Press (2006)) such as antioxidants like ascorbic acid or glutathione; preserving agents such as phenole, m-cresole, methyl- or propylparabene, chlorobutanol, thiomersal, and/or benzalkoniumchloride; stabilizers, framework formers such as sucrose, lactose, maltose, trehalose, mannitose, mannitol, and/or sorbitol; mannitol and/or lactose and solubilizers such as polyethyleneglycols (PEG; e.g., PEG 3000, 3350, 4000, or 6000), cyclodextrines (e.g., hydroxypropyle-β-cyclodextrine, sulfobutylethyl-β-cyclodextrine, or γ-cyclodextrine), dextranes, or poloxaomers (e.g., poloxamer 407 or poloxamer 188); or TWEEN® 20 or TWEEN® 80. In some embodiments, one or more well-tolerated excipients can be included, optionally selected from the group consisting of antioxidants, framework formers, and stabilizers.

In some embodiments, the pH for intravenous and/or intramuscular administration is selected from pH 2 to pH 12. In some embodiments, the pH for subcutaneous administration is selected from pH 2.7 to pH 9.0 as the rate of in vivo dilution is reduced resulting in more potential for irradiation at the injection site (Strickley, 2004).

V.C. Dosages

It is understood that a suitable dosage of a target peptide composition vaccine immunogen cam depend upon the age, sex, health, and/or weight of the recipient, the kind of concurrent treatment, if any, the frequency of treatment, and the nature of the effect desired. However, it is understood that dosages can be tailored to the individual subject, as determined by the researcher or clinician. The total dose required for any given treatment will in some embodiments be determined with respect to a standard reference dose based on the experience of the researcher or clinician, such dose being administered either in a single treatment or in a series of doses, the success of which will depend on the production of a desired immunological result (such as but not limited to successful production of a T helper cell and/or CTL-mediated response to the target peptide immunogen composition, which response gives rise to the prevention and/or treatment desired).

Thus, in some embodiments the overall administration schedule is considered in determining the success of a course of treatment and not whether a single dose, given in isolation, would or would not produce the desired immunologically therapeutic result or effect. As such, a therapeutically effective amount (i.e., in some embodiments that amount that produces a desired T helper cell and/or CTL-mediated response) can depend on the antigenic composition of the vaccine used, the nature of the disease condition, the severity of the disease condition, the extent of any need to prevent such a condition where it has not already been detected, the manner of administration dictated by the situation requiring such administration, the weight and state of health of the individual receiving such administration, and/or the sound judgment of the clinician or researcher. In some embodiments, the efficacy of administering additional doses and/or of increasing or decreasing the interval can be continually re-evaluated in view of the recipient's immunocompetence (including but not limited to the level of T helper cell and/or CTL activity with respect to tumor-associated or tumor-specific antigens).

The concentration of the T helper or CTL stimulatory target peptides of the presently disclosed subject matter in pharmaceutical formulations can be subject to wide variation, including anywhere from less than 0.01% by weight to as much as 50% or more. Factors such as volume and viscosity of the resulting composition can in some embodiments also be considered. The solvents or diluents used for such compositions can include water, phosphate buffered saline (PBS), and/or saline, or any other possible carriers or excipients.

The immunogens of the present presently disclosed subject matter can in some embodiments also be contained in artificially created structures such as liposomes, which structures in some embodiments can contain additional molecules such as but not limited to proteins or polysaccharides, inserted in the outer membranes of said structures and having the effect of targeting the liposomes to particular areas of the body and/or to particular cells within a given organ or tissue. Such targeting molecules can in some embodiments comprise an immunoglobulin. Antibodies can work particularly well for targeting of liposomes and/or other scaffolds to tumor cells.

Single i.d., i.m., s.c., i.p., and/or i.v. doses of in some embodiments about 1 to 50 μg, in some embodiments about 1 to 100 μg, in some embodiments about 1 to 500 μg, in some embodiments about 1 to 1000 μg, in some embodiments about 1 to 50 mg, in some embodiments about 1 to 100 mg, in some embodiments about 1 to 500 mg, or in some embodiments about 1 to 1000 mg of target peptide composition can be given and can depend from the respective compositions of target peptides with respect to total amount for all target peptides in the composition or alternatively for each individual target peptide in the composition. A single dose of a target peptide vaccine composition of the presently disclosed subject matter can in some embodiments have a target peptide amount (e.g., total amount for all target peptides in the composition or alternatively for each individual target peptide in the composition) of about or at least 1, 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, 525, 550, 575, 600, 625, 650, 675, 700, 725, 750, 775, 800, 825, 850, 875, 900, or 950 μg. In some embodiments, a single dose of a target peptide composition of the presently disclosed subject matter can have a total target peptide amount (e.g., total amount for all target peptides in the composition or alternatively for each individual target peptide in the composition) of about or at least 1, 5, 10, 15, 20, 25, 30, 35, 40, 45, 50, 55, 60, 65, 70, 75, 80, 85, 90, 95, 100, 125, 150, 175, 200, 225, 250, 275, 300, 325, 350, 375, 400, 425, 450, 475, 500, 525, 550, 575, 600, 625, 650, 675, 700, 725, 750, 775, 800, 825, 850, 875, 900, or 950 mg. In some embodiments, the target peptides of a composition of the presently disclosed subject matter are present in equal amounts of about 100 micrograms per dose in combination with an adjuvant peptide present in an amount of about 200 micrograms per dose.

In a single dose of the target peptide composition of the presently disclosed subject matter, the amount of each target peptide in the composition is in some embodiments equal or substantially equal. Alternatively, a ratio of the target peptides present in the least amount relative to the target peptide present in the greatest amount is about or at least 1:1.25, 1:1.5, 1:1.75, 1:2.0, 1:2.25, 1:2.5, 1:2.75, 1:3, 1:4, 1:5, 1:6, 1:7, 1:8, 1:9, 1:10, 1:20, 1:30; 1:40, 1:50, 1:100, 1:200, 1:500, 1:1000, 1:5000; 1:10,000; or 1:100,000. Alternatively, a ratio of the target peptides present in the least amount relative to the target peptide present in the greatest amount is about or at least 1 or 2 to 25; 1 or 2 to 20; 1 or 2 to 15; 1 or 2 to 10; 1 to 3; 1 to 4; 1 to 5; 1 to 6; 1 to 7; 1 to 10; 2 to 3; 2 to 4; 2 to 5; 2 to 6; 2 to 7; 2 to 10; 3 to 4; 3 to 5; 3 to 6; 3 to 7; 3 to 10; 5 to 10; 10 to 15; 15 to 20; 20 to 25; 1 to 40; 1 to 30; 1 to 20; 1 to 15; 10 to 40; 10 to 30; 10 to 20; 10 to 15; 20 to 40; 20 to 30; or 20 to 25; 1 to 100; 25 to 100; 50 to 100; 75 to 100; 25 to 75, 25 to 50, or 50 to 75; 25 to 40; 25 to 50; 30 to 50; 30 to 40; or 30 to 75.

Single dosages can be given to a patient about or at least 1, 2, 3, 4, or 5 times per day. Single dosages can be given to a patient about or at least 1, 2, 3, 4, 5, 6, 7, 8, 9, 10, 11, 12, 13, 14, 15, 16, 18, 19, 20, 21, 22, 23, 24, 36, 48, 60, or 72 hours subsequent to a previous dose.

Single dosages can be given to a patient about or at least 1, 2, 3, 4, 5, 6, or 7 times per week, or every other, third, fourth, or fifth day. Single doses can also be given every week, every other week, or only during 1, 2, or 3 weeks per month. A course of treatment can in some embodiments last about or at least 1, 2, 3, 4, 5, 6, 7, 8, 9, 10, 11. or 12 months.

In some embodiments, the single dosages of the compositions of the presently disclosed subject matter can be provided to a patient in at least two phases: e.g., during an initial phase and then during a subsequent phase. An initial phase can be about or at least 1, 2, 3, 4, 5, or 6 weeks in length. The subsequent phase can last at least or about 1, 2, 3, 4, 5, 6, 7, or 8 times as long as the initial phase. The initial phase can be separated from the subsequent phase by about or at least 1, 2, 3, 4, 5, 6, 7, 8, 9, 10, 11, or 12 weeks or months.

The target peptide composition dosage during the subsequent phase can be at least 1, 2, 3, 4, 5, 6, 7, 8, 9, 10, 15, 20, 30, 40, 50, 60, 70, 80, 90, 100, 200, 300, 400, 500, 600, 700, 800, 900, or 1000 times greater than during the initial phase.

The target peptide composition dosage during the subsequent phase can be at least 1, 2, 3, 4, 5, 6, 7, 8, 9, 10, 15, 20, 30, 40, 50, 60, 70, 80, 90, 100, 200, 300, 400, 500, 600, 700, 800, 900, or 1000 times less than during the initial phase.

In some embodiments, the initial phase is about three weeks and the second phase is about 9 weeks. The target peptide compositions can be administered to the patient on or about days 1, 8, 15, 36, 57, and 78.

V.D. Kits and Storage

In some embodiments, a kit is disclosed comprising (a) a container that contains at least one target peptide composition as described herein, in solution or in lyophilized form; (b) optionally, a second container containing a diluent or reconstituting solution for the lyophilized formulation; and (c) optionally, instructions for (i) use of the solution or (ii) reconstitution and/or use of the lyophilized formulation. The kit may further comprise one or more of (iii) a buffer, (iv) a diluent, (v) a filter, (vi) a needle, or (v) a syringe. In some embodiments, the container is selected from the group consisting of: a bottle, a vial, a syringe, a test tube, or a multi-use container. In some embodiments, the target peptide composition is lyophilized.

The kits can contain exactly, about, or at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 45, 46, 47, 48, 49, 50, 51, or more target peptide-containing compositions. Each composition in the kit can be administered at the same time or at different times.

In some embodiments, the kits can comprise a lyophilized formulation of the presently disclosed compositions and/or vaccines in a suitable container and instructions for its reconstitution and/or use. Suitable containers include, for example, bottles, vials (e.g., dual chamber vials), syringes (such as dual chamber syringes), and test tubes. The container can be formed from a variety of materials such as glass or plastic. In some embodiments, the kit and/or the container contain(s) instructions on or associated therewith that indicate(s) directions for reconstitution and/or use of a lyophilized formulation. For example, the label can indicate that the lyophilized formulation is to be reconstituted to target peptide concentrations as described herein. The label can further indicate that the formulation is useful or intended for subcutaneous administration. Lyophilized and liquid formulations are typically stored at −20° C. to −80° C.

The container holding the target peptide composition(s) can be a multi-use vial, which in some embodiments allows for repeat administrations (e.g., from 2-6 or more administrations) of the reconstituted formulation. The kit can further comprise a second container comprising a suitable diluent (e.g., sodium bicarbonate solution).

In some embodiments, upon mixing of the diluent and the lyophilized formulation, the final peptide concentration in the reconstituted formulation is at least or about 0.15, 0.20, 0.25, 0.5, 0.75, 1.0, 1.25, 1.5, 1.75, 2.0, 2.25, 2.5, 2.75, 3.0, 3.25, 3.50, 3.75, 4.0, 4.25, 4.5, 4.75, 5.0, 6.0, 7.0, 8.0, 9.0, or 10 mg/mL/target peptide. In some embodiments, upon mixing of the diluent and the lyophilized formulation, the final peptide concentration in the reconstituted formulation is at least or about 0.15, 0.20, 0.25, 0.5, 0.75, 1.0, 1.25, 1.5, 1.75, 2.0, 2.25, 2.5, 2.75, 3.0, 3.25, 3.50, 3.75, 4.0, 4.25, 4.5, 4.75, 5.0, 6.0, 7.0, 8.0, 9.0, or 10 µg/mL/target peptide.

The kit can further include other materials desirable from a commercial and/or user standpoint, including other buffers, diluents, filters, needles, syringes, and package inserts with or without instructions for use.

The kits can have a single container that contains the formulation of the target peptide compositions with or without other components (e.g., other compounds or compositions of these other compounds) or can have a distinct container for each component.

Additionally, the kits can include a formulation of the presently disclosed target peptide compositions and/or vaccines packaged for use in combination with the co-administration of a second compound (such as adjuvants including but not limited to imiquimod), a chemotherapeutic agent, a natural product, a hormone or antagonist, an anti-angiogenesis agent or inhibitor, an apoptosis-inducing agent or a chelator) or a composition thereof. One or more of the components of the kit can be pre-complexed or one or more components can be in a separate distinct container prior to administration to a patient. One or more of the components of the kit can be provided in one or more liquid solutions. In some embodiments, the liquid solution is an aqueous solution. In a further embodiment, the liquid solution is a sterile aqueous solution. One or more of the components of the kit can also be provided as solids, which in some embodiments can be converted into liquids by addition of suitable solvents, which in some embodiments can be provided in another distinct container.

The container of a therapeutic kit can be a vial, a test tube, a flask, a bottle, a syringe, or any other structure suitable for enclosing a solid or liquid. Typically, when there is more than one component, the kit contains a second vial or other container that allows for separate dosing. The kit can also contain another container for a pharmaceutically acceptable liquid. In some embodiments, a therapeutic kit contains an apparatus (e.g., one or more needles, syringes, eye droppers, pipette, etc.), which enables administration of the agents of the disclosure that are components of the kit.

V.E. Markers for Efficacy

When administered to a patient, the vaccine compositions of the presently disclosed subject matter are in some embodiments envisioned to have certain physiological effects including but not limited to the induction of a T cell mediated immune response.

V.E.1. Immunohistochemistry, Immunofluorescence, Western Blots, Flow Cytometry

Validation and testing of antibodies for characterization of cellular and molecular features of lymphoid neogenesis has been performed. Commercially available antibodies for use in immunohistochemistry (IHC), immunofluorescence (IF), flow cytometry (FC), and/or western bloting (WB) can be used. In some embodiments, such techniques can be employed to assay patient samples including but not limited to formalin-fixed, paraffin-embedded tissue samples for the presence or absence of and/or for a level of expression of one or more of CD1a, S100, CD83, DC-LAMP, CD3, CD4, CD8, CD20, CD45, CD79a, PNAd, TNFα, LIGHT, CCL19, CCL21, CXCL12, TLR4, TLR7, FoxP3, PD-1, and Ki67 gene products. In some embodiments, flow cytometry is used to determine an expression level for one or more of CD3, CD4, CD8, CD13, CD14, CD16, CD19, CD45RA, CD45RO, CD56, CD62L, CD27, CD28, CCR7, FoxP3 (intracellular), and MHC-peptide tetramers for I MHC associated (phospho)-peptides. In some embodiments, a positive control is employed, which in some embodiments can comprise a tissue sample comprising normal human peripheral blood lymphocytes (PBL), PBL activated with CD3/CD28 beads (activated PBL), human lymph node tissue from non-melanoma patients (LN), and/or inflamed human tissue from a surgical specimen of Crohn's disease (Crohn's), although any other positive control cell and/or tissue can be employed.

V.E.2 ELISpot Assay

In some embodiments, vaccination site infiltrating lymphocytes and lymphocytes from the sentinel immunized node (SIN) and vaccine site can be evaluated by ELISpot. ELISpot permits the direct counting of T cells reacting to antigen by production of INFγ. Peripheral blood lymphocytes can be evaluated by ELISpot assay for the number of peptide-reactive T cells. Vaccine site infiltrating lymphocytes and SIN lymphocytes can be compared to those in peripheral blood. It is envisioned that positive results of the ELISpot assay correlates with increased patient progression free survival. Progression free survival is defined as the time from start of treatment until death from any cause or date of last follow up.

V.E.3 Tetramer Assay

Peripheral blood lymphocytes and lymphocytes from the SIN and vaccine site can be evaluated by flow cytometry after incubation with MHC-peptide tetramers for the number of peptide-reactive T cells.

V.E.4 Proliferation Assay/Cytokine Analysis

Peripheral blood mononuclear cells (PBMC), vaccine-site inflammatory cells, and/or lymphocytes from the SIN isolated from subjects can be evaluated for CD4$^+$ T cell reactivity to, e.g., tetanus helper peptide mixture, using a $^3$H-thymidine uptake assay. Additionally, Th1 (IL-2, IFNγ, TNFα), Th2 (IL-4, IL-5, IL-10), Th17 (IL-17, and IL23), and T-reg (TGF-β) cytokines in media from 48 hours in that proliferation assay can be used to determine if the microenvironment supports generation of Th1, Th2, Th17, and/or T-reg responses. In some embodiments, one or both of the following peptides are used as negative controls: a tetanus peptide and the PADRE peptide (aK(X)VAAWTLKAa; SEQ ID NO: 2378).

V.E.5 Evaluation of Tumors

In some embodiments, tumor tissue collected prior to treatment or at the time of progression can be evaluated by routine histology and immunohistochemistry. Alternatively or in addition, in vitro evaluations of tumor tissue and tumor infiltrating lymphocytes can be performed.

V.E.6 Studies of Homing Receptor Expression

Patient samples can be studied for T cell homing receptors induced by vaccination with the compositions of the presently disclosed subject matter. These include, but are not limited to, integrins (including but not limited to αEβ7, α1β1, α4β1), chemokine receptors (including but not limited to CXCR3), and selectin ligands (including but not limited to CLA and PSL) on lymphocytes, and their ligands in the vaccine sites and SIN. In some embodiments, these can be assayed by immunohistochemistry, flow cytometry, and/or any other appropriate technique(s).

V.E.7 Studies of Gene and Protein Expression

Differences in gene expression and/or differences in protein expression profiles can be determined by high-throughput screening assays (e.g., nucleic acid chips, protein arrays, etc.) of samples isolated from vaccine sites and/or SIN.

VI Antibodies and Antibody-Like Molecules

Antibodies and antibody-like molecules (including but not limited to T cell receptors) specific for target peptides and/or target peptide/MHC complexes are in some embodiments useful for analyzing biological samples. In some embodiments, an analysis can comprise determining the pathological nature of tumor margins.

Antibodies and antibody-like molecules can also be used as therapeutics. In some embodiments, such molecules can be used as therapeutics that target cells, including but not limited to tumor cells, which display target peptides on their surfaces. In some embodiments, antibodies and antibody-like molecules bind to phosphorylated target peptides and/or target peptide-MHC complex specifically and do not substantially cross react with the corresponding non-phosphorylated native peptides.

As used herein, the terms "antibody", "antibody peptide(s)", and "antibody-like molecule(s)" refer to an intact antibody, a binding fragment thereof (i.e., a fragment of an antibody that comprises a paratope), or a polypeptide that can specifically recognize an antigen or epitope and bind to the same in a fashion that mimics antibody binding. In some embodiments, antibodies, antibody peptides, and antibody-like molecules compete with intact antibodies for specific binding to an antigen or epitope.

In some embodiments, antibody fragments can be produced by recombinant DNA techniques and/or by enzymatic and/or chemical cleavage of intact antibodies. Antibody fragments thus include but are not limited to Fab fragments, Fab' fragments, F(ab')$_2$ fragments, Fv, and single-chain antibodies including but not limited to single-chain fragment variable (scFv) antibodies. An antibody is said to be "monospecific" if each of its paratopes is identical and/or binds to the same epitope. Similarly, "bispecific" or "bifunctional" antibodies comprise paratopes that bind to different antigens and/or epitopes. In some embodiments, an antibody substantially inhibits adhesion of a receptor to a counterreceptor when an excess of antibody reduces the quantity of receptor bound to counterreceptor by at least about 20%, 40%, 60%, 80%, 85%, 90%, 95%, or more as measured by, for example, an in vitro competitive binding assay.

The term "MHC" as used herein refer to the Major Histocompatibility Complex, which is defined as a set of gene loci specifying major histocompatibility antigens. The term "HLA" as used herein will be understood to refer to Human Leukocyte Antigens, which is defined as the histocompatibility antigens found in humans. As used herein, "HLA" is the human form of "MHC". IN murine species, the MHC is referred to as the "H-2" complex.

The terms "MHC light chain" and "MHC heavy chain" as used herein refer to particular portions of a MHC molecule. Structurally, class I molecules are heterodimers comprised of two noncovalently bound polypeptide chains, a larger "heavy" chain (α) and a smaller "light" chain (β2-microglobulin or β2m). The polymorphic, polygenic heavy chain (45 kDa), encoded within the MHC on chromosome human 6 is subdivided into three extracellular domains (designated 1, 2, and 3), one intracellular domain, and one transmembrane domain. The two outermost extracellular domains, 1 and 2, together form the groove that binds to antigenic peptides and/or other epitopes. Thus, interaction with the TCR occurs at this region of the protein. Domain 3 of the molecule contains the recognition site for the CD8 protein on the CTL. This interaction serves to stabilize the contact between the T cell and an antigen-presenting cell (APC). The invariant light chain (12 kDa), encoded on human chromosome 15, consists of a single, extracellular polypeptide. The terms "MHC light chain", "β2-microglobulin", and "β2m" are used interchangeably herein.

The term "epitope" includes any protein determinant capable of specific binding to an antibody, antibody peptide, and/or antibody-like molecule (including but not limited to a T cell receptor) as defined herein. Epitopic determinants typically consist of chemically active surface groups of molecules such as amino acids or sugar side chains and generally have specific three dimensional structural characteristics as well as specific charge characteristics. An antibody or antibody-like molecule is said to "specifically" bind an antigen when the dissociation constant ($K_d$) is in some embodiments less than about 1 μM, in some embodiments less that about 100 nM, an in some embodiments less than about 10 nM. Interactions between antibodies and antibody-like molecules and an eptiope can also be characterized by an affinity constant ($K_a$). In some embodiments, a $K_a$ of less than about 10$^7$/M is considered "high affinity".

The term "antibody" is used in the broadest sense, and covers monoclonal antibodies (including full length monoclonal antibodies), polyclonal antibodies, multispecific antibodies (e.g., bispecific and/or trispecific antibodies), and antibody fragments (including but not limited to Fab, F(ab')$_2$ and Fv fragments) as well as antibody-like molecules provided that they exhibit the desired biological activity (e.g., antigen binding). Antibodies (Abs) and immunoglobulins (Igs) are glycoproteins that in some embodiments have the same structural characteristics. The term is also meant to encompass "antibody like molecules" and other members of the immunoglobulin superfamily including, but not limited to T cell receptors, MHC molecules, and other polypeptides that contain one or more antigen-binding regions and/or variable regions including, but not limited to complementary determining regions (CDRs) that specifically bind the target peptides disclosed herein.

In some embodiments, antibodies and antibody-like molecules bind to the target peptides disclosed herein but do not substantially and/or specifically crossreact with the same peptide in a modified form. See e.g., U.S. Patent Application Publication No. 2009/0226474, which is incorporated by reference.

The presently disclosed subject matter includes in some embodiments antibodies that recognize target peptides associated with a tumorigenic or disease state, wherein the peptides are displayed in the context of HLA molecules. These antibodies can mimic the specificity of a T cell receptor (TCR) but can have higher binding affinities such that the molecules can be employed as therapeutic, diagnostic, and/or research reagents. Methods of producing a T cell receptor mimic of the present presently disclosed subject matter in some embodiments comprise identifying a target peptide of interest, generating an isolating CD8$^+$ T cells comprising T cell receptors (TCRs) that are specific for the target peptide, and cloning the genomic sequences present in the isolated CD8$^+$ T cells that encode the TCRs that are specific for the target peptide.

In some embodiments, an immunogen comprising at least one target peptide/MHC complex is formed. An effective amount of the immunogen is in some embodiments administered to a host to elicit an immune response in the host, and serum collected from the host can assayed to determine if antibodies that recognize a three-dimensional presentation of the target peptide in the binding groove of the MHC molecule have been produced. The desired antibodies can in some embodiments differentiate the target peptide/MHC complex from the MHC molecule alone, the target peptide alone, and/or a complex of MHC and an irrelevant peptide (in some embodiments, a peptide having the same amino acid composition as a target peptide but wherein the amino acids are in a different order that in the target peptide) Finally, in some embodiments the desired antibodies can be isolated.

The term "antibody" also encompasses soluble T cell receptor (TCR) cytoplasmic domains that are stable at low concentrations and which can recognize MHC-peptide complexes. See e.g., U.S. Patent Application Publication No. 2002/0119149, which is incorporated by reference. Such soluble TCRs can in some embodiments be conjugated to immunostimulatory peptides and/or proteins, and/or moieties such as but not limited to CD3 agonists (e.g., anti-CD3 antibodies). The CD3 antigen is present on mature human T cells, thymocytes, and a subset of natural killer cells. It is associated with the TCR and is involved in signal transduction of the TCR. Antibodies specific for the human CD3 antigen are well known. One such antibody is the murine monoclonal antibody OKT3 which was the first monoclonal antibody approved by the FDA. OKT3 is reported to be a potent T cell mitogen (Van Wauve, 1980; U.S. Pat. No. 4,361,539) and a potent T cell killer (Wong, 1990). Other antibodies specific for the CD3 antigen have also been reported (see PCT International Patent Application Publication No. WO 2004/106380; U.S. Patent Application Publication No. 2004/0202657; U.S. Pat. Nos. 6,750,325; 6,706,265; Great Britain Patent Publication GB 2249310A; Clark et al., 1989; U.S. Pat. No. 5,968,509; U.S. Patent Application Publication No. 2009/0117102). Immune mobilising mTCR Against Cancer (ImmTAC; Immunocore Limited, Milton Partk, Abington, Oxon, United Kingdom) are bifunctional proteins that combine affinity monoclonal T cell receptor (mTCR) targeting with a therapeutic mechanism of action (i.e., an anti-CD3 scFv).

Native antibodies and immunoglobulins are generally heterotetrameric glycoproteins of about 150,000 daltons (Da) composed of two identical light (L) chains and two identical heavy (H) chains. Each light chain is linked to a heavy chain by a covalent disulfide bond. Disulfide bonds also link the heavy chains of intact antibodies, although the number of disulfide bonds between the heavy chains of different immunoglobulin isotypes can vary. Each heavy and light chain also has regularly spaced intrachain disulfide bridges. Each heavy chain has at one end a variable domain ($V_H$) followed by a number of constant domains. Each light chain has a variable domain at one end ($V_L$) and a constant domain at its other end. The constant domain of the light chain is aligned with the first constant domain of the heavy chain, and the light chain variable domain is aligned with the variable domain of the heavy chain. Particular amino acid residues are believed to form an interface between the light and heavy chain variable domains (Clothia et al., 1985; Novotny & Haber, 1985).

An "isolated" antibody is one which has been identified and/or separated and/or recovered from a component of the environment in which it was produced or otherwise present. Contaminant components of its production environment are materials that in some embodiments interfere with diagnostic and/or therapeutic uses for the antibody, and in some embodiments can include enzymes, hormones, and other proteinaceous or nonproteinaceous solutes. In some embodiments, an antibody can be purified as measurable by one or more of the following methods: 1) to greater than 50%, 75%, 80%, 85%, 90%, 95%, 96%, 97%, 98%, or 99% by weight of antibody as determined by the Lowry method; 2) to a degree sufficient to obtain at least 10 or 15 residues of N-terminal or internal amino acid sequence by use of a spinning cup sequenator; or 3) to homogeneity by SDS-PAGE under reducing or non-reducing conditions using Coomasie blue or, in some embodiments, silver stain. Isolated antibodies include an antibody in situ within recombinant cells since at least one component of the antibody's natural environment will not be present. Ordinarily, however, isolated antibodies will be prepared by a method that comprises at least one purification step.

The terms "antibody mutant" and "antibody variant" refer to antibodies that relative to a reference antibody comprise one or more amino acid sequence differences, wherein one or more of the amino acid residues have been modified such as but not limited to substitution and/or deletion. Such mutants and/or variants comprise in some embodiments less than 100%, 99%, 98%, 97%, 96%, 95%, 90%, 85%, 80%, or 75% sequence identity and/or similarity to the amino acid sequence of either the heavy or light chain variable domain amino acid sequence of the reference antibody.

The term "variable" in the context of variable domain of antibodies, refers to the fact that certain portions of the variable domains differ extensively in sequence among antibodies and are used in the binding and specificity of each particular antibody for its particular antigen. However, sequence variability is generally not evenly distributed throughout the variable domains of antibodies. Typically, seqeunce variability is concentrated in three segments called complementarity determining regions (CDRs; also known as hypervariable regions) both in the light chain and heavy chain variable domains.

There are at least two techniques for determining CDRs: (1) an approach based on cross-species sequence variability (i.e., Kabat et al., 1991); and (2) an approach based on crystallographic studies of antigen-antibody complexes (Chothia et al., 1989). The more highly conserved portions of variable domains are called the framework (FR). The variable domains of native heavy and light chains each comprise four FR regions, largely adopting a beta-sheet configuration, connected by three CDRs, which form loops connecting, and in some cases forming part of, the beta-sheet structure. The CDRs in each chain are held together in close proximity by the FR regions and, with the CDRs from the other chain, contribute to the formation of the antigen binding site of antibodies (see Kabat et al., 1991) The constant domains are generally not involved directly in binding between antibody and antigen, but exhibit various effector functions such as but not limited to participation of the antibody in antibody-dependent cellular toxicity.

The term "antibody fragment" refers to a portion of a full-length antibody, generally the antigen binding or variable region. Examples of antibody fragments include Fab, Fab', F(ab')$_2$, and Fv fragments. Papain digestion of antibodies produces two identical antigen binding fragments, called the Fab fragment, each with a single antigen binding site, and a residual "Fc" fragment, so-called for its ability to crystallize readily. Pepsin treatment yields an F(ab')$_2$ fragment that has two antigen binding fragments which are capable of cross-linking antigen, and a residual other fragment (which is termed pFc'). As used herein, the phrase "functional fragment" with respect to antibodies refers in some embodiments to a fragment that contains at least one antigen-binding domain (referred to as a "paratope"), and thus includes, but is not limited to Fv, F(ab) and F(ab')$_2$ fragments.

An "Fv" fragment is the minimum antibody fragment which contains a complete antigen recognition and binding site. This region consists of a heterodimer of one heavy and one light chain variable domain in a tight, non-covalent or covalent association ($V_H$-$V_L$ dimer). It is in this configuration that the three CDRs of each variable domain interact to define an antigen binding site (paratope) on the surface of the $V_H$-$V_L$ dimer. Collectively, the six CDRs confer antigen binding specificity to the antibody. However, in some embodiments even a single variable domain (or half of an Fv comprising only three CDRs specific for an antigen) has the ability to recognize and bind antigen, although at a lower affinity than the entire binding site.

The Fab or F(ab) fragment also contains the constant domain of the light chain and the first constant domain (CH1) of the heavy chain. Fab' fragments differ from Fab fragments by the addition of a few residues at the carboxyl terminus of the heavy chain CH1 domain including one or more cysteines from the antibody hinge region. Fab'-SH is the designation herein for Fab' in which the cysteine residue (s) of the constant domains have a free thiol group. F(ab') fragments are produced by cleavage of the disulfide bond at the hinge cysteines of the F(ab')$_2$ pepsin digestion product. Additional chemical couplings of antibody fragments are known to those of ordinary skill in the art.

The light chains of antibodies (immunoglobulin) from any vertebrate species can be assigned to one of two clearly distinct types, called kappa (κ) and lambda (λ), based on the amino sequences of the corresponding constant domain.

Depending on the amino acid sequences of the constant domain of their heavy chains, immunoglobulins can be assigned to different classes. There are at least five (5) major classes of immunoglobulins: IgA, IgD, IgE, IgG and IgM, and several of these may be further divided into subclasses or isotypes (e.g., IgG$_1$, IgG$_2$, IgG$_3$, IgG$_4$, IgA$_1$, IgA$_2$, etc.). The heavy chains constant domains that correspond to the different classes of immunoglobulins are called alpha (α), delta (Δ), epsilon (ε), gamma (γ), and mu (μ), respectively. The subunit structures and three-dimensional configurations of different classes of immunoglobulins are well known.

The term "monoclonal antibody" as used herein refers to an antibody obtained from a population of substantially homogeneous antibodies, i.e., the individual antibodies comprising the population are identical except for possible naturally occurring mutations that can be present in minor amounts. Monoclonal antibodies are highly specific, being directed against a single antigenic site. Furthermore, in contrast to conventional (polyclonal) antibody preparations, which typically include different antibodies directed against different determinants (epitopes), each monoclonal antibody is directed against a single determinant on the antigen. In additional to their specificity, monoclonal antibodies can be advantageous in that they are typically synthesized from hybridomas and thus can be isolated in a form that is uncontaminated by other immunoglobulins. Methods for generating hybridomas are known in the art. The modifier "monoclonal" indicates the character of the antibody as being obtained from a substantially homogeneous population of antibodies, and is not to be construed as requiring production of the antibody by any particular method. By way of example and not limitation, monoclonal antibodies to be used in accordance with the presently disclosed subject matter can be made by the hybridoma method first described by Kohler & Milstein, 1975, or can be made by recombinant methods (see e.g., U.S. Pat. No. 4,816,567; Harlow & Lane, 1988). In some embodiments, the monoclonal antibodies for use with the presently disclosed subject matter can be isolated from phage antibody libraries using the techniques described in Clackson et al., 1991 and/or Marks et al., 1991.

Utilization of the monoclonal antibodies of the presently disclosed subject matter can in some embodiments comprise administering one or more monoclonal antibodies to a subject, such as but not limited to a human subject. However, when the monoclonal antibodies are produced in a non-human animal, such as a rodent, administration of such antibodies to a human patient can elicit an immune response, wherein the immune response is directed towards the administered antibodies themselves. Such reactions can limit the duration and effectiveness of such a therapy. In order to overcome such a problem, the monoclonal antibodies of the presently disclosed subject matter can in some embodiments be "humanized", that is, the antibodies are engineered such that antigenic portions thereof are removed and like portions of a human antibody are substituted therefor, while the antibodies' affinity for specific peptide/MHC complexes is retained. This engineering can involve a few amino acids, or can include the entire framework regions of the antibody, leaving only the complementarity determining regions of the parent antibody intact. Several methods of humanizing antibodies are known in the art and are disclosed in U.S. Pat. Nos. 6,180,370; 6,054,927; 5,869,619; 5,861,155; 5,712, 120; and 4,816,567, the entire disclosure of each of which is hereby expressly incorporated herein by reference in its entirety.

Humanized forms of antibodies are thus chimeric immunoglobulins, immunoglobulin chains, or fragments thereof (such as Fv, Fab, Fab', F(ab')$_2$ or other antigen-binding subsequences of antibodies) that are principally comprised of the sequence of a human immunoglobulin, but that contain at least some subsequences derived from a non-human immunoglobulin. Humanization can be performed following the method of Winter and co-workers by substituting rodent CDRs or CDR sequences for the corresponding sequences of a human antibody (Jones et al., 1986; Riechmann et al., 1988; Verhoeyen et al., 1988; see also U.S. Pat. No. 5,225,539). In some embodiments, $F_v$ framework residues of a human immunoglobulin are replaced with corresponding non-human residues from an antibody of interest. Humanized antibodies can also comprise residues which are found neither in the recipient antibody nor in the imported CDR or framework sequences. In general, the humanized antibody comprises substantially all of at least one, and typically two, variable domains, in which all or substantially all of the CDR regions correspond to those of a non-human immunoglobulin and all or substantially all of the framework regions are those of a human immunoglobulin consensus sequence. The humanized antibody optimally can also comprise at least a portion of an immunoglobulin constant region (Fc), typically that of a human immunoglobulin (Jones et al., 1986; Riechmann et al., 1988; and Presta, 1992).

Exemplary publications relating to the generation and/or use of humanized antibodies include Sandborn et al., 2001; Mihara et al., 2001; Yenari et al., 2001; Morales et al., 2000; Richards et al., 1999; Yenari et al., 1998; and Shinkura et al., 1998; each of which is expressly incorporated by reference herein in its entirety. For example, a treatment protocol that can be utilized in such a method includes a single dose, generally administered intravenously, of 10-20 mg of humanized mAb per kg (see e.g., Sandborn et al., 2001). In some cases, alternative dosing patterns can be appropriate, such as the use of three infusions, administered once every two weeks, of 800-1600 mg or even higher amounts of humanized mAb (see e.g., Richards et al., 1999). However, it is to be understood that the presently disclosed subject matter is not limited to the treatment protocols described herein, and further that other treatment protocols that are known to one of ordinary skill in the art can be employed in the methods of the presently disclosed subject matter.

In some embodiments, the presently disclosed subject matter further relates to fully human monoclonal antibodies against specific target peptide/MHC complexes. Fully human antibodies essentially relate to antibody molecules in which the entire sequence of both the light chain and the heavy chain, including the CDRs, arise from human genes. Such antibodies are referred to herein as "human antibodies" or "fully human antibodies".

Human monoclonal antibodies can be prepared by the trioma technique (see U.S. Pat. No. 4,714,681; PCT International Patent Application Publication No. WO 1999/047929); the human B-cell hybridoma technique (see Kozbor et al., 1983), and/or the EBV hybridoma technique (see Cole et al., 1985). In some embodiments, human monoclonal antibodies can be utilized in the practice of the presently disclosed subject matter and can be produced by using human hybridomas (see Cote et al., 1983) or by transforming human B-cells with Epstein Barr Virus in vitro (see Cole et al., 1985). In addition, human antibodies can also be produced using additional techniques, such as bnot limited to phage display libraries (Hoogenboom et al., 1991; Marks et al., 1991). Similarly, human antibodies can be made by introducing human immunoglobulin loci into transgenic animals, e.g., mice in which the endogenous immunoglobulin genes have been partially or completely inactivated. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633, 425; 5,661,016, and in Marks et al., 1992; Lonberg et al., 1994; Fishwild et al., 1996; Neuberger, 1996; and Lonberg & Huszar, 1995.

Human antibodies can additionally be produced using transgenic non-human animals that have been modified to produce fully human antibodies in addition to or rather than the non-human animal's endogenous antibodies in response to challenge by an antigen. See PCT International Patent Application Publication No. WO 1994/02602. In some embodiments, endogenous genes encoding the heavy and light immunoglobulin chains present in the non-human animal have been deleted or otherwise inactivated, and nucleic acids encoding human heavy and light chain immunoglobulins have been inserted into the host's genome. The human genes are incorporated, for example, using yeast artificial chromosomes containing the requisite human DNA segments. An animal that provides all the desired modifications is then obtained as progeny by crossbreeding intermediate transgenic animals containing fewer than the full complement of the modifications.

One embodiment of such a non-human animal is a mouse termed the XENOMOUSE™, which is described in PCT International Patent Application Publication Nos. WO 1996/33735 and WO 1996/34096. The XENOMOUSE™ produces B cells that secrete fully human immunoglobulins. The antibodies can be obtained directly from the animal after immunization with an immunogen of interest, as, for example, a preparation of polyclonal antibodies, or alternatively from immortalized B cells derived from an immunized animal, such as hybridomas producing monoclonal antibodies. Additionally, the genes encoding the immunoglobulins with human variable regions can be recovered and expressed to obtain the antibodies directly and/or can be further modified to obtain analogs of antibodies such as, for example, single chain Fv molecules.

An example of a method for producing a non-human animal such as but not limited to a mouse that lacks expression of an endogenous immunoglobulin heavy chain is disclosed in U.S. Pat. No. 5,939,598, incorporated herein by reference. Such a non-human animal can be obtained by a method that comprises deleting the J segment genes from at least one endogenous heavy chain locus in an embryonic stem cell, thereby preventing rearrangement of the locus and formation of an RNA encoding a rearranged immunoglobulin heavy chain locus. In some embodiments, the deletion can be effected by a targeting vector that contains a selectable marker, Thereafter, a transgenic animal (e.g., a mouse) having somatic and germ cells containing the gene encoding the selectable marker can be produced from the embryonic stem cell. The transgenic animal would be expected to be unable to rearrange its endogenous immunoglobulin heavy chain locus, and thus would be expected to be unable to produce endogenous immunoglobulins.

A method for producing an antibody of interest, such as a human antibody, is also disclosed in U.S. Pat. No. 5,916,771, incorporated herein by reference. It includes introducing a first expression vector that contains a nucleotide sequence encoding a heavy chain into one mammalian host cell in culture, introducing a second expression vector containing a nucleotide sequence encoding a light chain into another mammalian host cell, and fusing the two cells to form a hybrid cell. The hybrid cell can express thus an antibody made up of a heavy chain and a light chain encoded by the first and second expression vectors.

Target peptides disclosed herein are in some embodiments expressed on a variety of cancer cell types. Thus, in some embodiments antibodies and antibody-like molecules can be used in treating, diagnosing, vaccinating, preventing, retarding, and attenuating a cancer such as but not limited to melanoma, ovarian cancer, breast cancer, colorectal cancer, squamous carcinoma of the lung, sarcoma, renal cell carcinoma, pancreatic carcinomas, squamous tumors of the head and neck, leukemia, brain cancer, liver cancer, prostate cancer, ovarian cancer, and cervical cancer.

Antibodies generated with specificity for a target peptide as disclosed herein can be used to detect the corresponding target peptides in a biological sample. The biological sample is in some embodiments isolated from an individual who is suspected of having cancer, and thus detection could serve to diagnose the cancer. Alternatively, the biological sample could be isolated from an individual known to have cancer, and detection of a target peptide therein can serve as an indicator of disease prognosis, cancer characterization, treatment efficacy, disease progression, or any combination thereof. Immunoassays that can be employed for these purposes are known in the art and include, but are not limited to, immunohistochemistry, flow cytometry, radioimmunoassay, western blotting, and ELISA. Biological samples suitable for such testing include, but are not limited to, cells, tissue biopsy specimens, whole blood, plasma, serum, sputum, cerebrospinal fluid, pleural fluid, and urine.

Antigens recognized by T cells, whether helper T lymphocytes or CTL, are not recognized as intact proteins, but rather as small peptides that associate with class I or class II MHC proteins on the surface of cells. During the course of a naturally occurring immune response, antigens that are recognized in association with class II MHC molecules on antigen presenting cells (APCs) are acquired from outside the cell, internalized, and processed into small peptides that associate with the class II MHC molecules.

Antigens that give rise to proteins that are recognized in association with class I MHC molecules are generally proteins that are produced within the cells, and these antigens are processed and associate with class I MHC molecules. It is now understood that the peptides that associate with given class I or class II MHC molecules are characterized as having a common binding motif, and the binding motifs for a large number of different class I and II MHC molecules have been determined. Synthetic peptides can also be synthesized that correspond to the amino acid sequence of a given antigen and that contain a binding motif for a given class I or II MHC molecule. These peptides can then be added to appropriate APCs, and the APCs can be used to stimulate a T helper cell or CTL response either in vitro or in vivo. The binding motifs, methods for synthesizing the peptides, and methods for stimulating a T helper cell or CTL response are all known and readily available to one of ordinary skill in the art.

Kits can be prepared to assist in diagnosis, monitoring, and/or prognosis of diseases. In some embodiments, the kits facilitate the detection and/or measurement of cancer-specific phosphopeptides and/or phosphoproteins. Such kits can contain, in a single or divided container, a molecule comprising an antigen-binding region. In some embodiments, such molecules are antibodies or antibody-like molecules. Additional components that can be included in the kit include one or more of solid supports, detection reagents, secondary antibodies, instructions for use, vessels for running assays, gels, control samples, and the like. In some embodiments, an antibody or antibody-like molecules can optionally be directly or indirectly labeled.

Alternatively, the antibody or antibody-like molecules specific for phosphopeptides and/or phosphopeptide/MHC complexes can be conjugated to therapeutic agents. Exemplary therapeutic agents include, but are not limited to the following:

Alkylating Agents: Alkylating agents are drugs that directly interact with genomic DNA to prevent cells from proliferating. This category of chemotherapeutic drugs represents agents that affect all phases of the cell cycle (i.e., they are not cell cycle phase-specific). Alkylating agents include, but are not limited to nitrogen mustards, ethylenimenes, methylmelamines, alkyl sulfonates, nitrosoureas, and triazines. Particularly exemplary alkylating agents include but are not limited to busulfan, chlorambucil, cisplatin, cyclophosphamide (cytoxan), dacarbazine, ifosfamide, mechlorethamine (mustargen), and melphalan.

Antimetabolites: Antimetabolites disrupt DNA and RNA synthesis. Unlike alkylating agents, they specifically influence the cell cycle during S phase. Antimetabolites can be differentiated into various categories, such as folic acid analogs, pyrimidine analogs, purine analogs, and related inhibitory compounds. Antimetabolites include but are not limited to 5-fluorouracil (5-FU), cytarabine (Ara-C), fludarabine, gemcitabine, and methotrexate.

Natural Products: Natural products generally refer to compounds originally isolated from a natural source and identified as having a desirable pharmacological activity. Such compounds, including analogs and derivatives thereof, can be isolated from a natural source, chemically synthesized, and/or recombinantly produced by any technique known to those of skill in the art. Natural products include such categories as mitotic inhibitors, antitumor antibiotics, enzymes, and biological response modifiers.

Mitotic inhibitors include plant alkaloids and other natural agents that can in some embodiments inhibit protein synthesis required for cell division and in some embodiments inhibiting mitosis. They typically operate during a specific phase of the cell cycle. Mitotic inhibitors include, for example, docetaxel, etoposide (VP16), teniposide, paclitaxel, taxol, vinblastine, vincristine, and vinorelbine, amoung others.

Taxoids are a class of related compounds isolated from the bark of the ash tree, *Taxus brevifolia*. Taxoids include but are not limited to compounds such as docetaxel and paclitaxel. Paclitaxel binds to tubulin (at a site distinct from that used by the vinca alkaloids) and promotes the assembly of microtubules.

Vinca alkaloids are a type of plant alkaloid identified to have pharmaceutical activity. Exemplary vinca alkaloids include vinblastine (VLB) and vincristine.

Antibiotics: Certain antibiotics have both antimicrobial and/or cytotoxic activity. These drugs also interfere with DNA by chemically inhibiting enzymes and mitosis or altering cellular membranes. These agents are typically not cell cycle phase-specific. Examples of cytotoxic antibiotics include but are not limited to bleomycin, dactinomycin, daunorubicin, doxorubicin (Adriamycin), plicamycin (mithramycin), and idarubicin.

Miscellaneous Agents: Miscellaneous cytotoxic agents that do not fall into the previous categories include but are not limited to platinum coordination complexes, anthracenediones, substituted ureas, methyl hydrazine derivatives, amsacrine, L-asparaginase, and tretinoin. Platinum coordination complexes include such compounds as carboplatin and cisplatin (cis-DDP). An exemplary anthracenedione is mitoxantrone. An exemplary substituted urea is hydroxyurea. An exemplary methyl hydrazine derivative is procarbazine (N-methylhydrazine, MIH). These examples are non-limiting and it is contemplated that any known cytotoxic, cytostatic, and/or cytocidal agent can be attached to a targeting peptide of the presently disclosed subject matter and administered to a targeted organ, tissue, and/or cell type.

Chemotherapeutic (cytotoxic) agents including, but are not limited to, 5-fluorouracil, bleomycin, busulfan, camptothecin, carboplatin, chlorambucil, cisplatin (CDDP), cyclophosphamide, dactinomycin, daunorubicin, doxorubicin, estrogen receptor binding agents, etoposide (VP16), farnesyl-protein transferase inhibitors, gemcitabine, ifosfamide, mechlorethamine, melphalan, mitomycin, navelbine, nitrosurea, plicomycin, procarbazine, raioxifene, tamoxifen, taxol, temazolomide (an aqueous form of DTIC), transplatinum, vinblastine, methotrexate, vincristine, and any analogs and/or derivatives or variants of the foregoing. Most chemotherapeutic agents fall into the categories of alkylating agents, antimetabolites, antitumor antibiotics, corticosteroid hormones, mitotic inhibitors, and nitrosoureas, hormone agents, miscellaneous agents, and any analog, derivative, or variant thereof.

VII. Beta-Catenin

The breadth of expression of β-catenin phosphorylated at S33, the expression of a phosphorylated peptide epitope derived from this sequence, and the immunogenicity of the epitope are disclosed herein. PhosphoS33-β-catenin is broadly expressed in human metastatic melanoma tissues and cell lines and in breast cancer cell lines. Levels of phosphoS33-β-catenin (i.e., human β-catenin phosphorylated at Serine-33) are also detected in normal spleen, liver, and kidney tissues, as well as in cultured melanocytes, but pS33-βcat$_{30}$ (SEQ ID NO: 427) was found to be presented by melanoma and breast cancer cells and not cultured melanocytes. The level of pS33-βcat$_{30}$ epitope displayed on melanoma cells did not correlate with the steady state expression level of the phosphoprotein, but rather correlated with the total amount of phosphoprotein available for degradation. This, in turn, was influenced by the subcellular localization of β-catenin.

pS33-βcat$_{30}$ (SEQ ID NO: 427) is only very weakly immunogenic. Surprisingly, however, replacement of the alanine with a valine at the C-terminus created an antigenically distinct phosphopeptide (SEQ ID NO: 2080) with an enhanced HLA*A0201 binding affinity and immunogenicity. Even more surprising, T cells generated from mice immunized with the modified phosphopeptide recognized endogenously processed pS33-βcat$_{30}$ presented on melanoma and breast cancer cells and also controlled outgrowth of a melanoma xenograft. Interestingly, the phosphate at S37 of human β-catenin is more susceptible to phosphatases and is removed during antigen processing and presentation after GSK-3β phosphorylates S33 and S37 to mark β-catenin for degradation. As such, pS33-βcat$_{30}$ is disclosed herein to be a good immunotherapeutic target for melanoma and breast cancers and that effective pS33-βcat-specific T cells can be induced using the modified phosphopeptide pS33-βcat(V)$_{30}$ (SEQ ID NO: 2080).

PhosphoS33-β-catenin was found to be homogenously expressed in the cytoplasm of the vast majority of metastatic melanoma samples. This is consistent with the fact that phosphorylation of β-catenin by GSK-3β occurs in the cytoplasm (Seidensticker & Behrens, 2000). A previous study using an antibody directed against β-catenin phosphorylated at S33, S37, and/or T41 reported that phospho-β-catenin expression was exclusively nuclear in both primary and metastatic melanomas (Kielhorn et al., 2003). Elevated nuclear expression of β-catenin in a small number of samples was observed. A similar pattern of cytoplasmic staining using either the antibody specific for phosphoS33-β-catenin or a different batch of the phosphor-β-catenin antibody used in the earlier study was also observed.

It was also observed that mitotic tumor cells with condensed chromosomes expressed elevated levels of phosphoS33-β-catenin. β-catenin levels increase in the cytoplasm and nucleus up to the G2/M phase of the cell cycle, after which they rapidly decline, and degradation of β-catenin is apparently essential for cells to move beyond the G2/M phase (Olmeda et al., 2003). This suggests that cells that are cycling more rapidly should present higher levels of pS33-βcat$_{30}$. Related to this, the levels of phosphoS33-β-catenin and total β-catenin detected in normal human spleen, liver, and kidney tissues were much lower than those of metastatic melanoma tissues. Phospho33-β-catenin was also detected in cultured melanocytes in the steady state and the level of expression increased when proteasome degradation was inhibited, which raises the possibility that pS33-βcat$_{30}$ could be presented by primary melanocytes. However, pS33-βcat$_{30}$ was not in the repertoire of phosphopeptides presented by cultured melanocytes. Melanocytes rarely proliferate in vivo (Jimbow et al., 1975) and when propagated in vitro, they divide at a much slower rate than melanoma cells. As such, the total amount of β-catenin that is phosphorylated and degraded in melanocytes is likely to be lower than in melanoma cells.

pS33-βcat-specific T cell recognition of melanoma cells correlated with the total levels of phosphoS33-β-catenin and β-catenin after blockade of the proteasome rather than with steady state levels, indicating that differences in epitope display are tied to differences in the rate of β-catenin protein phosphorylation and degradation that are superimposed on differences of β-catenin gene expression. This is consistent with other work demonstrating that the steady state level of a protein might not directly correlate with the level of presentation of an epitope derived from it (Berzofsky et al., 1988; Restifo et al., 1993; Niedermann et al., 1995; Yewdell, 2002; Nunes et al., 2011). However, consistent with other investigators (Hulsken et al., 1994; Kimelman & Xu, 2006), the experiments disclosed herein showed a negative correlation between membranous and nuclear localization of β-catenin and the pool of β-catenin that was available to be phosphorylated and degraded. Thus, subcellular localization of β-catenin can be used as a surrogate measure of the level of epitope display on melanoma cells. Importantly, the levels of membranous and nuclear β-catenin were low in the vast majority of metastatic melanoma samples that were evaluated, suggesting that they were likely to display adequate levels of pS33-βcat$_{30}$ for T cell recognition.

Phosphorylation of serine-37 in human β-catenin is a prerequisite for GSK-3β-mediated phosphorylation of serine-33 (Fiol et al., 1988; Fiol et al., 1990) and phosphorylation of both sites is required for ubiquitination of β-catenin by β-transducin repeat-containing protein (β-TrCP) to target it for proteasome degradation (Liu et al., 2002; Sadot et al., 2002). Despite the lack of a phosphate at serine-37, that the pS33-βcat$_{30}$ epitope is derived from GSK-3β-mediated phosphorylation of β-catenin is disclosed herein. The doubly phosphorylated peptide, pS33/S37-βcat$_{30}$, binds moderately well to HLA-A*0201, suggesting that that the lack of pS33/S37-βcat$_{30}$ presentation on melanoma cells (Zarling et al., 2006) is likely due to the removal of the phosphate at S37 during antigen processing and presentation. Peptides with a phosphate group at P4, such as pS33-βcat$_{30}$, or P5, have been shown to be protected from phosphatases when they are bound to the MHC molecule (Petersen et al., 2009). This is likely due to interactions established between the phosphate, the peptide backbone, and the MHC molecule (Mohammed et al., 2008; Petersen et al., 2009). It was found that both serine-33 (P4) and serine-37 (P8) were protected from phosphatases when the doubly phosphorylated peptide was bound to the MHC molecule. However, the serine-37 phosphosite was inherently more prone to dephosphorylation. Thus, the lack of a phosphate at serine-37 in pS33-βcat$_{30}$ likely reflects the differential susceptibility of the phosphosites to dephosphorylation during antigen processing prior to binding to HLA-A*0201.

Although pS33-βcat$_{30}$ binds with moderate affinity to HLA-A*0201, it induced specific human T cells only after several weeks of in vitro culture and was very poorly immunogenic in vivo in HLA-A*0201 transgenic mice. Although not wishing to be bound by any theory, it is possible that the lack of response to pS33-βcat$_{30}$ is because its HLA-A*0201-binding affinity is not high enough to allow sufficient antigen presentation in vivo. It has been shown that peptides with similar or even lower HLA-A*0201 binding affinities can induce immune responses in vivo (Sette et al., 1994; Bullock et al., 2000). The enhanced immunogenicity of the modified pS33-βcat(V)$_{30}$ epitope might be due to the fact that it is antigenically distinct from pS33-βcat$_{30}$ and that it binds HLA-A*0201 with higher affinity. Regardless of the exact mechanisms, the more immunogenic modified phosphopeptide induced T cells that strongly cross-reacted with the natural phosphopeptide in an equivalent manner. Thus, pS33-βcat(V)$_{30}$ can be used advantageously in place of the natural phosphopeptide in vaccines or to generate antigen-specific T cells for adoptive immunotherapy.

Tumor antigens that are broadly expressed are appealing as immunotherapeutic targets, as the majority of antigens identified to date are expressed largely or exclusively in melanomas (Lucas & Coulie, 2008). Although a colorectal cancer cell line with a truncating mutation in APC that diminishes degradation of β-catenin was not recognized, breast cancer cells, which rarely have mutations in β-catenin or components of the destruction complex, were also effectively recognized by the pS33-βcat-specific T cells. Thus, while pS33-βcat$_{30}$-targeted therapy might be of reduced applicability to cancers that have mutations in APC or frequent mutations in β-catenin and/or components of the destruction complex such as gastrointestinal (Morin et al., 1997) and endometriod ovarian (Oliva et al., 2006) cancers, pS33-βcat$_{30}$ might be an effective target for renal (Kim et al., 2000), lung (Ohgaki et al., 2004), thyroid (Miyake et al., 2001), pituitary adenomas (Sun et al., 2005), and some types of pancreatic cancer (Gerdes et al., 1999), as these tumors rarely show mutations in β-catenin or proteins of the destruction complex. As such, pS33-βcat$_{30}$ is a good target for cancer immunotherapy and is a broad tumor antigen.

VIII. Additional Applications

Disclosed herein are phosphorylated antigens including many displayed on the surface of primary hematological malignant tissues. Many were HLA-B7-restricted and tumor-specific, and an additional several HLA-A2-restricted tumor-specific antigens not found on healthy tissue were studied. Many of these antigens are derived from important oncoproteins linked to leukemogenesis, such as RUNX1, MLL, Myc, and Bcl-11A. The present disclosure demonstrates that some HLA alleles present a dramatically larger number of phosphorylated antigens than others that are differentially displayed between normal and malignant tissue. The present disclosure establishes for the first time the surface expression of phosphorylated antigens on the surface of primary tumor tissue which are also analyzed on defined counterpart healthy tissue.

There was a statistically significant increase in the number of phosphopeptides present on malignant tissue compared with non-malignant tissue that was demonstrated for both HLA-A2 and HLA-B7 alleles consistent with perturbation in tumor-related signaling.

Unexpectedly, immune responses were present against the majority of the phosphorylated target peptides tested amongst healthy individuals. These T cells, when expanded in vitro, are able to recognize and kill malignant tissue: both established cells lines and primary tumor samples. Cold-target inhibition studies reveal that these phosphopeptide-specific T cell lines kill primary tumor tissue in a phosphopeptide-specific manner. In some cases, these phosphopeptide-specific T cells bound HLA-phosphopeptide tetramers. This indicated that phosphopeptide-specific T cells express high affinity TCRs that have escaped thymic deletion, which embodies the greatest barrier for current immunotherapeutic strategies.

When patients with CLL were investigated they were found to have significantly lower levels of phosphopeptide-specific immunity than a healthy control group, despite the fact that all of these patients had robust CD8$^+$ T cell responses to polyclonal stimuli.

Figure 10A:
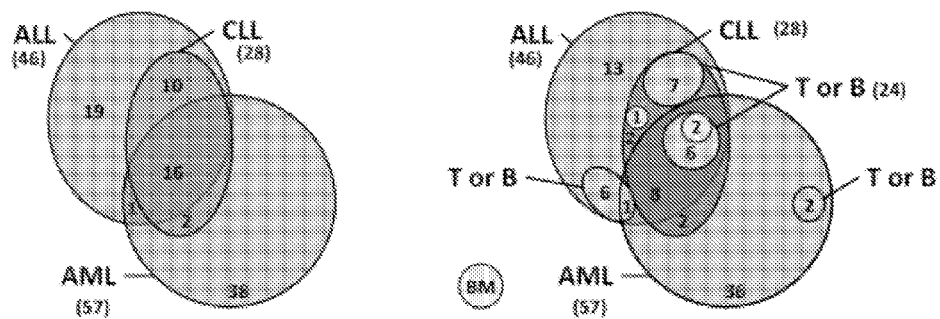
FIGS. 10A-10I summarize analyses of identified phosphopeptides.
Figure 10B:
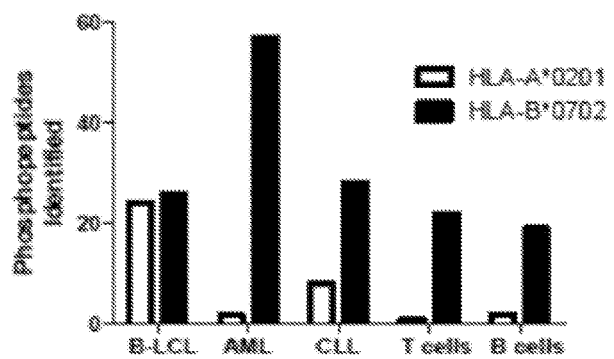
Figure 10C:
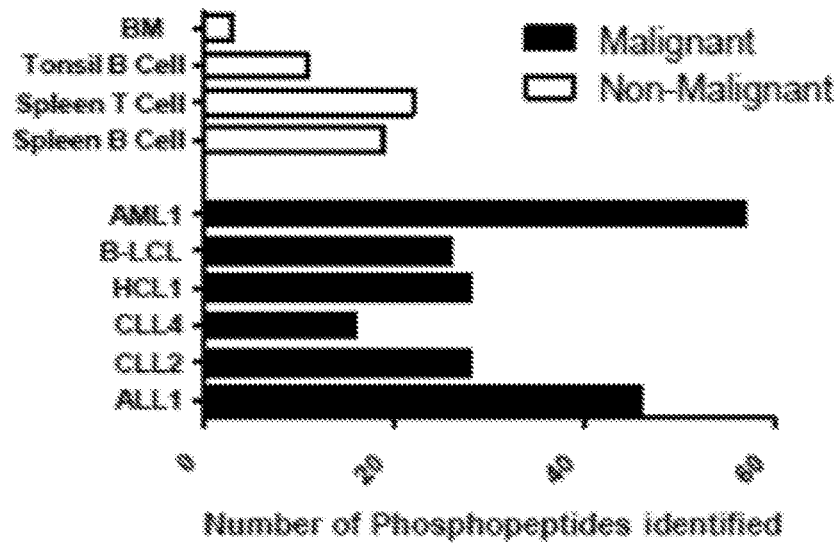

Interestingly, patients with leukemia can be divided into two groups: those with no detectable or barely detectable anti-phosphopeptide responses and those with intact immune responses very similar to healthy individuals (see also FIG. 10C).

There is a prognostic and/or clinical difference between these two groups as one clearly sees impact in overall survival according to the presence or absence of anti-phosphopeptide immunity in patients with CLL and AML.

The data presented herein indicated that phosphoantigens play a critical role in preventing the development and/or progression of malignant disease, and thus phosphoantigen-directed immunity has great potential for anti-cancer immunotherapeutic strategies.

Data from CLL are in keeping with current models of immunoediting. In patients where CLL-associated anti-phosphopeptide immunity was present, clinical outcome was more favorable. This fits with an equivalence stage, where tumor-expansion is limited by ongoing tumor killing by the immune response. These data would explain why CLL, for many patients, is an indolent disease where 30% never require any treatment.

The mechanisms by which stem cell transplantation (SCT) induces a curative outcome for aggressive leukemias are poorly understood. Current models implicate allogeneic immune response targeting minor antigens, and indeed minor antigens have been identified. Yet multiple studies have revealed that SCT between identical twins is also associated with curative outcomes. The data disclosed herein suggested, for what is believed to be the first time, that endogenous immunity against post-translationally modified tumor antigens could play a role in the induction of a curative outcome following SCT by reconstituting anti-tumor immunity that had been lost and/or had never formed in patients with leukemia. It has been known for some time that matching donor immunity toward patient-resident endogenous viral antigens improves outcome. It is envisioned that outcome following SCT could also be improved by matching anti-phosphoantigen responses to phosphoantigenic display on leukemia cells.

Unexpectedly, all 20 healthy donors tested had evidence of primed cytotoxic immunity against leukemia-associated tumor phosphoantigens. Indeed the level of immunity against these phosphoantigens was of the same magnitude as that seen against non-persistent immunodominant viral epitopes. The mechanism that led to the priming of these memory responses is of interest. It could be that adaptive immune responses encounter and eradicate either malignant or pre-malignant cells during one's lifetime, priming this response. It could be that the diminishment of such a response is responsible for the incidence of malignant disease seen in later life. Therefore, cancer could be seen as a functional immunodeficiency.

The majority of epitopes identified and tested as targets for immunotherapy thus far have been derived from non-mutated proteins expressed at elevated levels on tumor cells. While CD8+ T cell responses against such non-mutated peptides have been detected in the blood in a large proportion of patients following vaccination, overall, the rate of major clinical responses has been low.

The peptides identified and tested thus far in peptide-based vaccine approaches have generally fallen into one of three categories: 1) mutated on individual tumors, and thus not displayed on a broad cross-section of tumors from different patients; 2) derived from unmutated tissue-specific proteins, and thus compromised by mechanisms of self-tolerance; and 3) expressed in subsets of cancer cells and normal testes.

Antigens linked to transformation or oncogenic processes are of primary interest for immunotherapeutic development based on the hypothesis that tumor escape through mutation of these proteins could be more difficult without compromising tumor growth or metastatic potential The target peptides of the presently disclosed subject matter are in some embodiments unique in that the identified target peptides are modified by intracellular modification. This modification is of particular relevance because it is associated with a variety of cellular control processes, some of which are dysregulated in cancer cells. For example, the source proteins for class I MHC-associated phosphopeptides are often known phosphoproteins, supporting the idea that the phosphopeptides are processed from folded proteins participating in signaling pathways.

Although not wishing to be bound by any particular theory, it is envisioned that in some embodiments the target peptides of the presently disclosed subject matter are unexpectedly superior than known tumor-associated antigen-derived peptides for use in immunotherapy because: 1) they only displayed on the surface of cells in which intracellular phosphorylation is dysregulated (i.e., cancer cells) and not normal thymus cells, and thus they are not compromised by self-tolerance (as opposed to TAAs generally, which are associated with overexpression or otherwise expressed on non-mutated cells); and/or 2) they identify a cell displaying them on their surface as having dysregulated phosphorylation. Thus, post-translationally modified phosphopeptides that are differentially displayed on cancer cells and derived from source proteins objectively linked to cellular transformation and metastasis allow for more extensive anti-tumor responses to be elicited following vaccination. Target peptides are, therefore, better immunogens in peptide-based vaccines, as target peptides are derived from proteins involved with cellular growth control, survival, and/or metastasis, and alterations in these proteins as a mechanism of immune escape might interfere with the malignant phenotype of tumors.

As such, the presently disclosed subject matter also includes in some embodiments methods of identifying target peptides for use in immunotherapy which are displayed on transformed cells but are not substantially expressed on normal tissue in general or in the thymus in particular. In some embodiments, such target peptides bind the MHC class I molecule more tightly than their non-phosphorylated native counterparts. Moreover, such target peptides might have additional binding strength by having amino acid substitutions at certain anchor positions. In some embodiments, such modified target peptides will remain cross-reactive with TCRs specific for native target peptide MHC complexes.

Additionally, it is envisioned that the target peptides associated with proteins involved in intracellular signaling cascades or cycle regulation are of particular interest for use in immunotherapy. In some cases, the TCR might specifically react with the phosphate groups on the target peptide being displayed on an MHC class I molecule.

In some embodiments, a method for screening target peptides for use in immunotherapy (e.g., in adaptive cell therapy or in a vaccine) involves determining whether the candidate target peptides are capable of inducing a memory T cell response. The contemplated screening methods can include providing target peptides (including but not limited to those disclosed herein or those to be identified in the future) to a healthy volunteer and determining the extent to which a target peptide-specific T cell response is observed. In some embodiments, the extent to which the T cell response is a memory T cell response is also determined. In some embodiments, the extent to which a $T_{CM}$ response is elicited, such as but not limited to the extent to which a $T_{CM}$ response is elicited relative to other T cell types, is determined. In some embodiments, those target peptides that are capable of inducing a memory T cell response in healthy and/or diseased patients are selected for inclusion in the therapeutic compositions of the presently disclosed subject matter.

In some embodiments, the presently disclosed subject matter also provides methods for inducing a target peptide-specific memory T cell (e.g., $T_{CM}$) response in a patient by providing the patient with a composition comprising the target peptides disclosed herein. In some embodiments, the compositions are provided in a dosing regimen as disclosed herein.

In some embodiments, the presently disclosed subject matter also relates to methods for determining a cancer disease prognosis. These methods can involve providing a patient with target peptide compositions and determining the extent to which the patient is able to mount a target peptide-specific T cell response. In some embodiments, the target peptide composition comprises target peptides selected in substantially the same manner that one would select target peptides for inclusion in a therapeutic composition. If a patient is able to mount a significant target peptide specific T cell response, then the patient is likely to have a better prognosis than a patient with the similar disease and therapeutic regimen who is not able to mount a target peptide specific T cell response. In some embodiments, the methods involve determining whether the target peptide specific T cell response is a $T_{CM}$ response. In some embodiments, the presence of a target peptide-specific T cell response as a result of the contemplated diagnostic method correlates with an at least or about 5, 10, 15, 20, 25, 30, 35, 40, 45, 50, 55, 60, 65, 70, 75, 80, 85, 90, 95, 100, 125, 150, 175, 200, 250, 300, 400, 500 or more percent increase in progression free survival over standard of care.

The above disclosure generally describes the presently disclosed subject matter. A more complete understanding can be obtained by reference to the following specific examples which are provided herein for purposes of illus-

EXAMPLES

The following Examples provide further illustrative embodiments. In light of the present disclosure and the general level of skill in the art, those of skill will appreciate that the following EXAMPLES are intended to be exemplary only and that numerous changes, modifications, and alterations can be employed without departing from the scope of the presently disclosed subject matter.

Example 1

Summary of Targeting Peptides

The present EXAMPLE encompasses inter alia a set of phosphorylated peptides presented by HLA A*0101, A*0301, B*4402, B*2705, B*1402, B*0702 and A*0201 on the surface of melanoma cells that have the potential to (a) stimulate an immune response to the cancer, (b) to function as immunotherapeutics in adoptive T cell therapy or as a vaccine, (c) to facilitate antibody recognition of the tumor boundaries in surgical pathology samples, and (d) act as biomarkers for early detection of the disease. The presently disclosed subject matter provides in some embodiments class I MHC peptides presented on the surface of melanoma cells in association with the HLA molecules A*0101, A*0301, B*4402, B*2705, B*1402, B*0702 and A*0201.

Tables 9-16 (see below) provide examples of target peptides within the scope of the presently disclosed subject matter. Sequence identifiers are listed in the first column. The UniProt database Accession numbers listed provide the sequences of the full human proteins from which the peptides are derived. The UniProt sequences are incorporated by reference. Also included are the Start and Stop amino acid positions as set forth in the listed UniProt database Accession numbers.

The class I phosphopeptide antigens reported here allow adoptive T cell therapy to be extended to melanoma patients that do not express the HLA-A*0201 allele and also make it possible to treat a variety of other cancers by the same approach.

One can clone the T cell receptor on the murine cytotoxic T cells and then inject the corresponding DNA into normal human T cells. This process turns them into cytotoxic T cells that now recognize cancer cells that express the same class I phosphopeptides derived from IRS-2 and β-catenin. It is disclosed herein that this process can be used to convert cancer patient T-cells into activated cytotoxic T cells that recognize class I phosphopeptides and kill their tumor. These experiments provide for use of class I phosphopeptides in adopted T cell therapy of cancer. This approach has shown dramatic success in the treatment of advanced stage metastatic melanoma. It should be noted that HLA A*0201 and HLA *A0301 both present peptides from the IRS-2 protein that contain the same phosphorylation site, Ser1100. RVApSPTSGV (SEQ ID NO: 418) binds to HLA A*0201 and both RVApSPTSSGVK (SEQ ID NO: 65) and RVApSPTSGVKR (SEQ ID NO: 66) bind to HLA A*0301. Neither of the A*0301 peptides bind to A*0201 and the A*0201 peptide cannot be presented by the A*0301 molecule.

Example 2

Mice

Transgenic mice expressing a chimeric class I MHC molecule comprised of the α1 and α2 domains of human HLA-A*0201 and the α3 domain of murine H-2D$^d$ (AAD Tg) have been previously described (Newberg et al., 1992). NOD/SCID IL-2Rγ-chain deficient mice were from The Jackson Laboratory, Bar Harbor, Me., United States of America. The mice were housed and cared for in accordance with guidelines of the University of Virginia Animal Use and Care (University of Virginia, Charlottesville, Va., United States of America).

Example 3

Cell Lines and Reagents

DM331, SLM2, VMM12, and VMM18 melanoma lines have been previously described (Zarling et al., 2006). 1363 Mel was from Dr. Susan Topalian (Johns Hopkins University, Baltimore, Md., United States of America). MCF7, MDAMB231, MDAMB468, and T47D breast cancer cell lines were from Dr. Sarah Parsons (University of Virginia, Charlottesville, Va., United States of America), and the SW620 colorectal cancer cell line (CCL-227) was purchased from the American Type Culture Collection (ATCC®; Manassas, Va., United States of America). Cultured melanocytes were isolated from neonatal skin and grown in medium 254 and human melanocyte growth supplement (INVITROGEN™, Carlsbad, Calif., United States of America). The cancer cells were transfected to stably express a recombinant form of HLA-A*0201 called AAD (Newberg et al., 1992). The melanoma and colorectal cancer cells were grown at 37° C. with 5% $CO_2$ in RPMI-1640 containing 10% FBS and breast cancer cells were grown at 37° C. with 8% $CO_2$ in DMEM supplemented with 10% fetal bovine serum (FBS). Peptides were synthesized by GenScript USA Inc., Piscataway, N.J., United States of America.

Example 4

Antibodies and Cytokines

PhosphoS33-β-catenin and β-catenin specific antibodies were from Santa Cruz Biotechnology, Inc. (Dallas, Tex., United States of America) and Epitomics (an Abcam Company, Burlingame, Calif., United States of America). HRP-conjugated anti-GAPDH was from Cell Signaling Technology, Inc. (Danvers, Mass., United States of America). αCD40 (FGK45; Fischbein et al., 2000) was provided by Dr. Stephen Schoenberger (La Jolla Institute of Allergy and Immunology, La Jolla, Calif., United States of America). Anti-CD8α (53.67), anti-IFNγ (XMG1.2), and anti-TNFα (TN3-19) were from eBiosciences, Inc. (San Diego, Calif., United States of America).

Example 5

HLA-A*0201-Associated Phosphopeptides from Cultured Melanocytes

HLA-A*0201-associated phosphopeptides were isolated from $1.05 \times 10^9$ cultured melanocytes pooled from four different donors using BB7.2 antibody and immobilized metal ion affinity chromatography and then analyzed by mass spectrometry as previously described (Zarling et al., 2006).

Example 6

Immunohistochemical Analysis

Formalin-fixed paraffin-embedded cell line pellets and tissue microarrays of metastatic melanoma and normal tissue samples (Biorepository and Tissue Research Facility at the University of Virginia, Charlottesville, Va., United States of America) were deparaffinized, rehydrated, counterstained with hematoxylin, and imaged on an Aperio Scanner (Aperio, Vista, Calif., United States of America). Samples were incubated with anti-phosphoS33-β-catenin overnight at 4° C. after antigen retrieval and antibody was detected using the IMMPACT™ AEC reagent (Vector Laboratories, Inc., Burlingame, Calif., United States of America). Antibodies were removed with ethanol and acidified potassium permanganate and then reprobed with anti-β-catenin. The staining index (SI) was calculated as total positive pixel count/mm$^2$ using ImageScope software. Results were compared to manual scores assigned by a pathologist to verify accuracy. SI ranged from less than 0.1-3.0×10$^9$. Samples with SI less than 0.4×10$^9$ were scored as negative, 0.4-1.2×10$^9$ were scored as low, 1.2-2×10$^9$ were scored as moderate, and 2-3×10$^9$ were scored as high. Membranous β-catenin was scored as follows: low: 0-25% of cells; moderate: 25-50% of cells; and high: greater than 50%. Samples showing at least 10% of cells with nuclear β-catenin were scored as positive.

Example 7

Human T Cell Culture and Cr-Release Assay

T cells isolated using a Human Pan T cell isolation kit (BD Biosciences, San Jose, Calif., United States of America) were co-cultured with autologous phosphopeptide-pulsed DCs matured with GM-CSF, IL-4 (both from R&D Systems, Inc., Minneapolis, Minn., United States of America), IL-1β, IL-6, TNFα (all from PeproTech, Rocky Hill, N.J., United States of America), and prostaglandin E$_2$ (Sigma-Aldrich Co. LLC, St. Louis, Mo., United States of America) for 7 days. These cultures were restimulated every 7 to 10 days using either irradiated PBLs or HLA-A*0201$^+$ B lymphoblastoid cell lines (BLCLs) in AIM V media (INVITROGEN™) containing 10% AB$^+$ serum, IL-7, IL-10, and IL-15 (all from PeproTech). Effector function of antigen-specific T cells was assessed by a standard $^{51}$Cr release assay using C1R-A2 target cells pulsed with 5 µg/ml of the phosphorylated or unphosphorylated forms of the β-catenin peptide. Radioactivity values for unpulsed targets were subtracted from the values recorded for the pulsed targets. Normalized % specific lysis was calculated as (corrected radioactivity values for pulsed targets/values for positive controls)×100).

Example 8

Tetramers

Monomers of phosphopeptide-MHC-β$_2$M complexes were generated as previously described (Altman et al., 1996). Equimolar amount of streptavidin-conjugated PE fluorochrome was added slowly to biotinylated monomers to generate tetramers.

Example 9

HLA-A*0201 Peptide-Binding A

Affinity purified HLA-A*0201 was incubated with iodinated peptide FLPSPDYFPSV (SEQ ID NO: 2379), graded doses of test peptides, and β$_2$M as previously described (Zarling et al., 2000). Peptide-MHC complexes were captured in W6/32-coated ELISA plates after 48 hours and the dose at which test peptides inhibited binding of the indicator peptide by 50% (IC$_{50}$) was calculated.

Example 10

Immunizations and Ex Vivo Analysis of Effector Function

Murine bone marrow-derived dendritic cells (BMDCs) activated with CD40L-expressing 3T3 fibroblasts were prepared as previously described (Bullock et al., 2000), pulsed with 10 µg/ml of peptide, and injected i.v. into AAD Tg mice. Seven days later, IFNγ and TNFα production was evaluated by intracellular cytokine staining (ICS) in splenic CD8α T cells after incubation with peptide-pulsed C1R-AAD BLCL stimulators. For recall responses, mice previously immunized with peptide-pulsed BMDCs were boosted 28-30 days later i.v. with 100 µg of peptide, 100 µg CpG (type C), and 50 µg of FGK45 antibody in saline and IFNγ and TNFα production was assessed 5 days later as above. Analysis of cross-reactivity was evaluated using mice that had been immunized with phosphopeptide-pulsed BMDCs and boosted with phosphopeptide, CpG, and FGK45 antibody 6 days later.

Example 11

In Vitro Culture of Murine T Cells

CD8 T cells isolated from mice 3 weeks after immunization with pS33-βcat(V)$_{30}$-pulsed BMDCs were stimulated weekly with irradiated pS33-βcat$_{30}$ or pS33-βcat(V)$_{30}$-pulsed AAD$^+$ splenocytes as previously described (Zarling et al., 2000).

Example 12

Tumor Control 7-8 week old male NOD/SCID/IL-2Rγc$^{-/-}$ mice were inoculated subcutaneously with 1.4-2×10$^6$ AAD$^+$ SLM2 cells. 6-7×10$^6$ effector pS33-βcat-specific T cells were adoptively transferred 3 days later and an additional 0.3-1×10$^6$ effector T cells after an additional 4 days. All mice received 1500U of IL-2 (R&D Systems, Inc., Minneapolis, Minn., United States of America) i.p. every other day for 10 days. Tumor size was measured every 2-3 days with a digital caliper. Tumor size was calculated as L×W.

Example 13

Western Blot

Lysates were prepared from ~80% confluent cells in buffer containing 2% Triton X 100 and protease and phosphatase inhibitors. Samples were separated on 8% SDS-PAGE (Thermo Fischer Scientific Inc., Waltham, Mass., United States of America) and transferred to PVDF membranes (Millipore Immobilon-FL, 0.45 μm; Millipore Corporation, Billerica, Mass., United States of America). Blots were probed with phosphoS33-β-catenin, β-catenin, and GAPDH antibodies overnight at 4° C. and developed by enhanced chemiluminescence (Millipore). Films were scanned and integrated density values determined using AlphaEase software and normalized to values obtained for GAPDH. In some cases, GSK-3 activity was inhibited using 5 μg BIO ((2'Z, 3'E)-6-Bromoindirubin-3'-oxime) and proteasomal degradation was blocked with 10 μg lactacystin (Calbiochem) before cells were lysed.

Example 14

T Cell Recognition of GSK-3β- and Proteasome-Inhibited Melanoma Cells

Melanoma cells were treated with 5 μM of BIO or MeBIO (an inactive form of BIO) for 4 hours or left untreated. Surface peptide-MHC complexes were denatured from the cells using a mild acid buffer as previously described (Robila et al., 2008) and then allowed to re-express peptide-MHC molecules in the presence of BIO, MeBIO, or 5 μM lactacystin for 12 hours. T cell recognition of the cells was evaluated after 5 hours incubation with pS33-βcat-specific T cells.

Example 15

Dephosphorylation Assay and Peptide Isolation

Unbound pS33/S37-βcat$_{30}$ and pS33/S37-βcat$_{30}$ bound to the MHC complex were treated separately with 0.2 U/μg of alkaline phosphatase in 100 mM ammonium bicarbonate (pH 9) for 60 minutes at 37° C. Aliquots of the reaction mixture were removed at various time points, acidified with 5% trifluoroacetic acid and loaded onto StageTips (Rappsilber et al., 2007) that were fabricated by packing 0.5 mm of $C_{18}$ reversed-phase resin (15 μm diameter, 120 A pore size, YMC, Kyoto, Japan) onto an Empore disk that had been conditioned by treatment with three 10 pmol aliquots of Angiotensin I in 80% acetonitrile (ACN)/0.5% acetic acid (AcOH). Peptides were eluted from the StageTip using a four step-gradient, 10 μL aliquots of 20, 40, 60, and 80%% acetonitrile in 0.5% acetic acid. Eluant was lyophilized and the resulting dried peptides were redissolved in 0.1% acetic acid and analyzed by microcapillary HPLC interfaced to an electrospray ionization source on a LTQ-FT-ion cyclotron resonance mass spectrometer (Thermo Fisher Scientific, Bremen, Germany) as previously described (Hall et al., 2010).

Example 16

Statistical Analysis

Wilcoxon rank-sum, cox proportional hazard modeling, parametric modeling, and two-tailed Student t tests were performed to determine statistical significance where indicated. p values less than 0.05 were considered significant.

Example 17

Expression of PhosphoS33-β-Catenin in Metastatic Melanoma

Figure 1A:
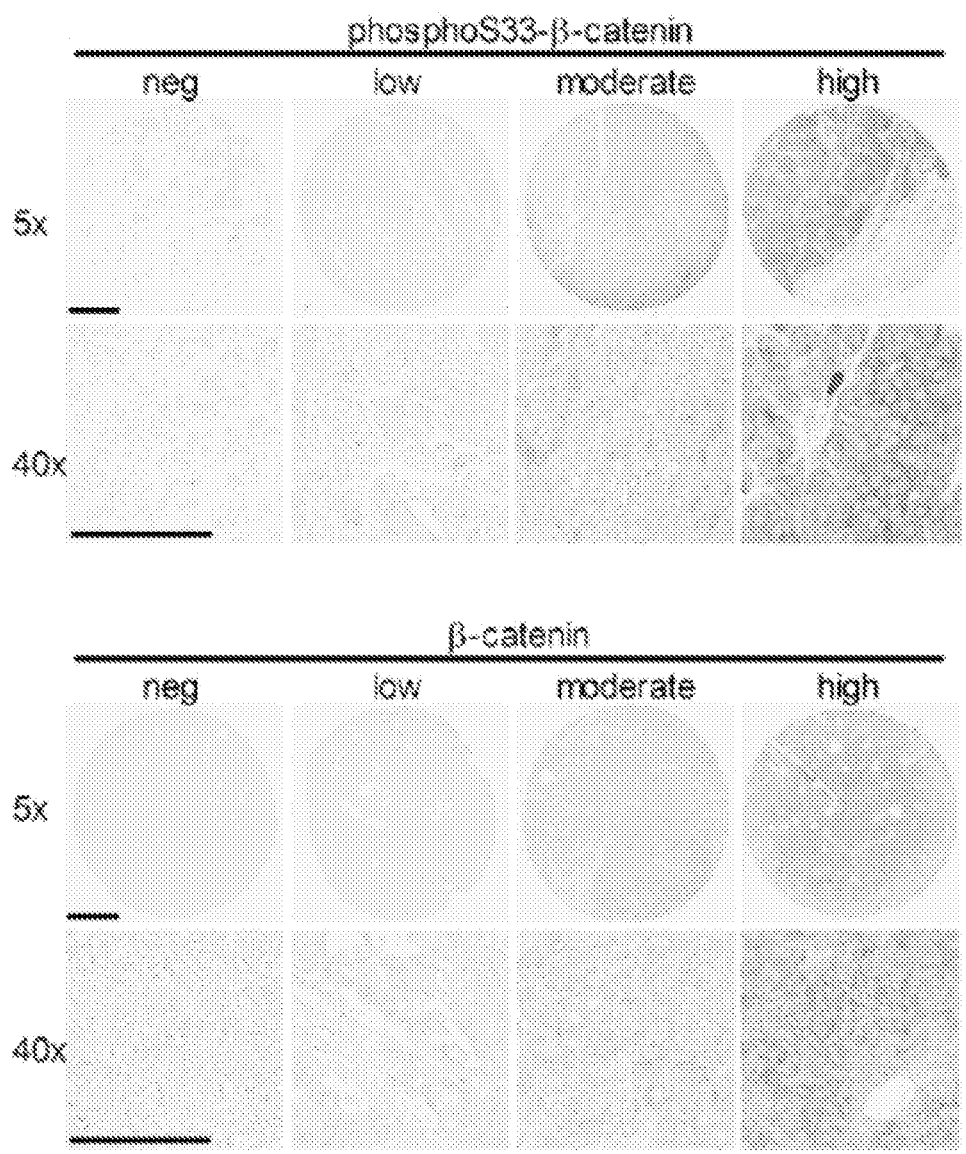
FIGS. 1A-1E show that phosphoS33-β-catenin was broadly expressed in human melanoma.
Figure 1B:
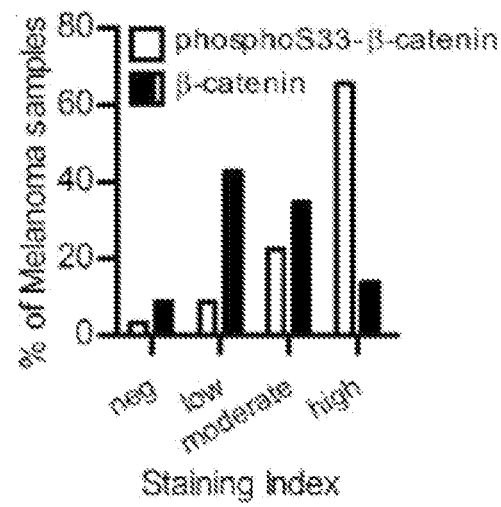
Figure 1C:
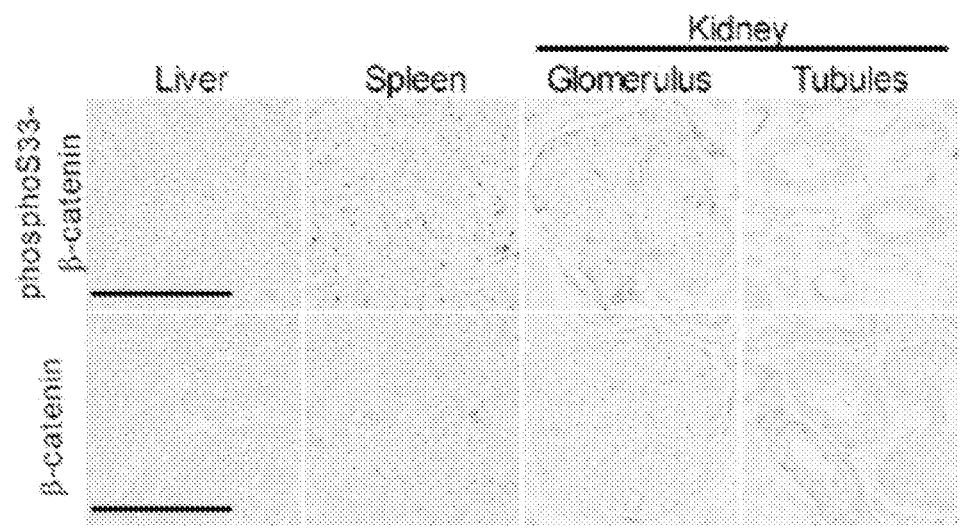
Figure 1D:
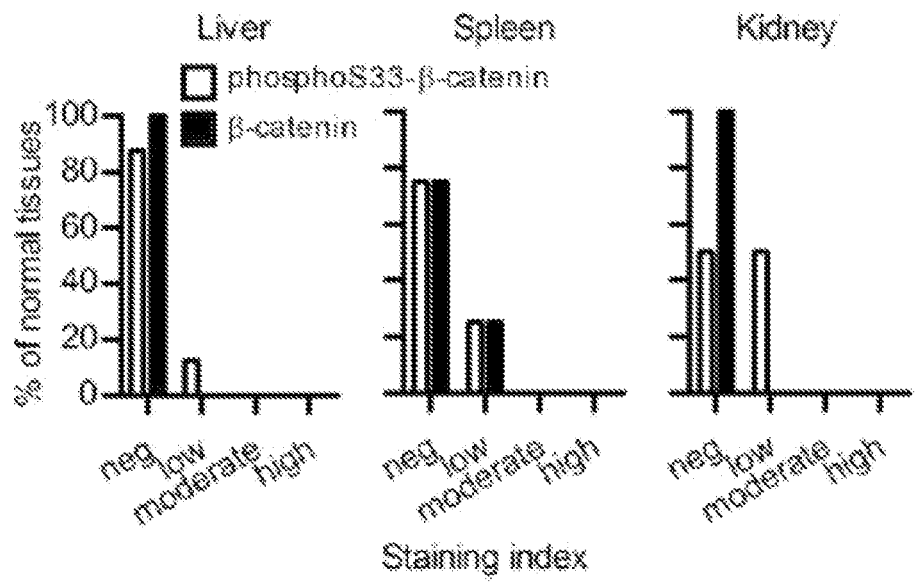
Figures 8A, 8B:
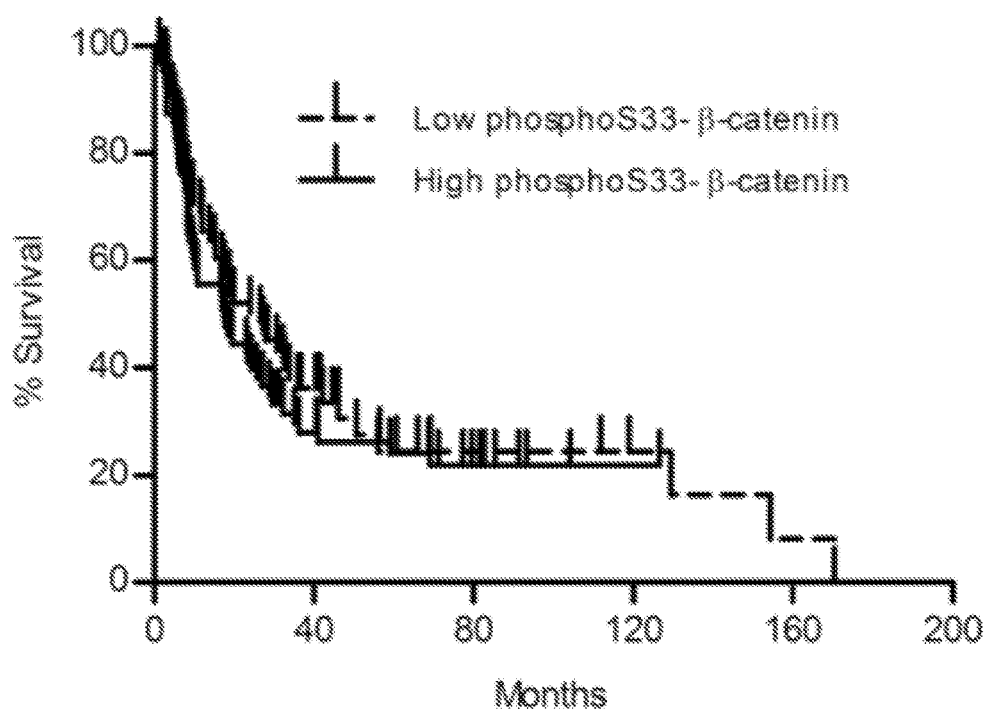
FIGS. 8A-8D present the results of experiments demonstrating that the level of phosphoS33-β-catenin and β-catenin expressed in Stage III and Stage IV metastatic melanomas did not correlate with survival. The level of phosphoS33-β-catenin (FIGS. 8A and 8B) and β-catenin (FIGS. 8C and 8D) in metastatic melanoma tissues from FIG. 1 were divided into low and high at the median of expression. Kaplan-Meier survival curves from the date of surgery to the last follow-up were fitted by Cox proportional hazard model using the PHREG procedure in SAS 9.2 to examine survival against phosphoS33-β-catenin or β-catenin expression, adjusting for age and stage.
Figures 8C, 8D:
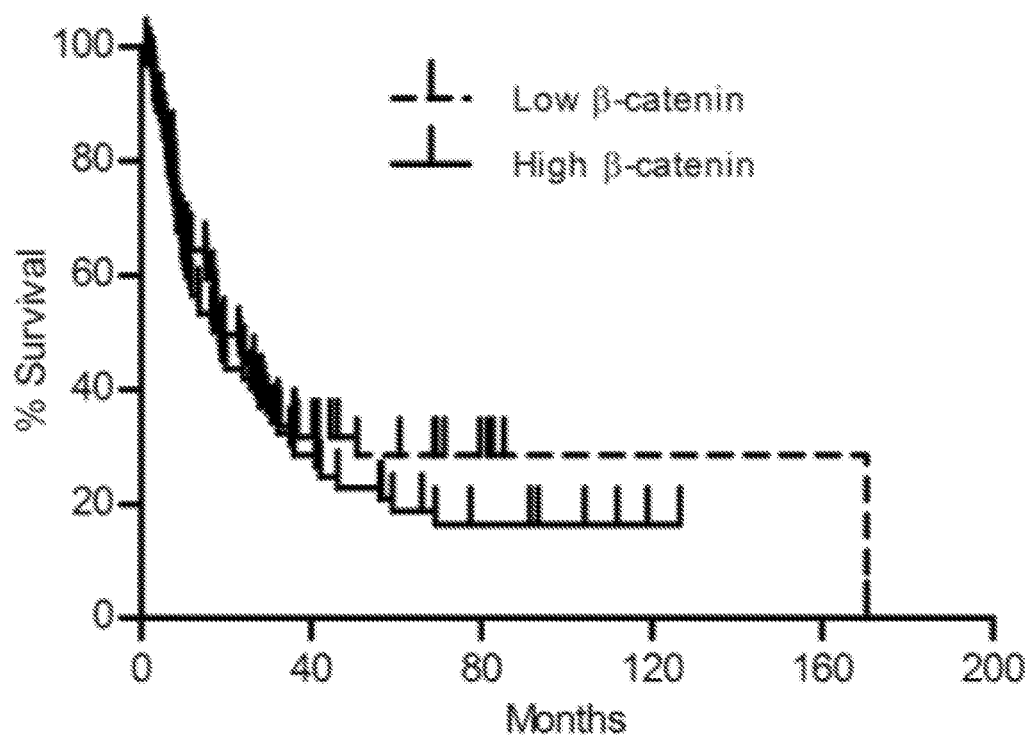
Figure 9A:
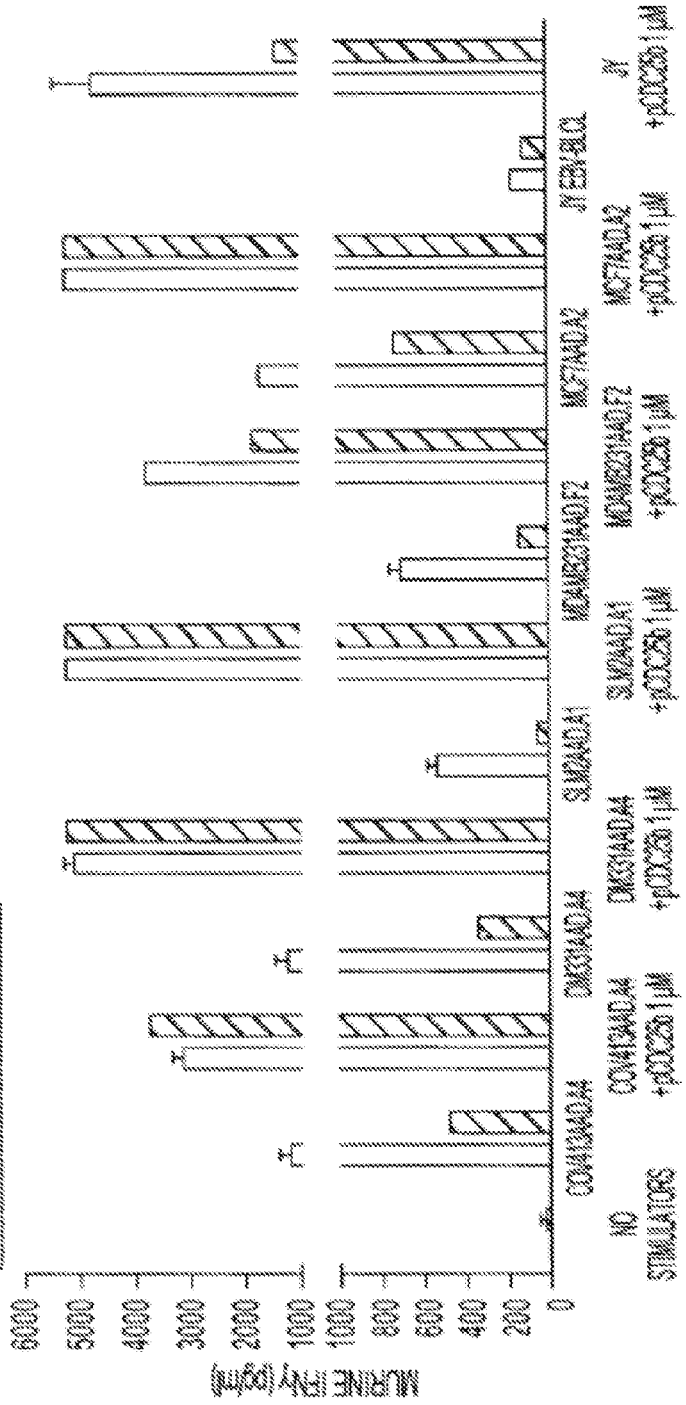
FIGS. 9A and 9B are bar graphs of the recognition of naturally processed and presented phosphorylated peptides on cancer cells by the phosphopeptide-specific CTL. Phosphopeptide-specific CTL were incubated with the following cancer cell lines or EBV-transformed B lymphoblastoid cell lines (BLCL): COV413.AAD.A4 ovarian carcinoma, DM331.AAD.A4 and SLM2.AAD.A1 melanomas, MCF7.AAD.A2 and MDAMB231.AAD breast carcinomas, and JY EBV-BLCL. Supernatants were harvested and evaluated for the presence of murine IFNγ (produced by murine CTL lines). As a positive control, cancer cells were pulsed with the specific phosphopeptide to show that they are capable of presenting exogenously added peptide.
Figure 9B:
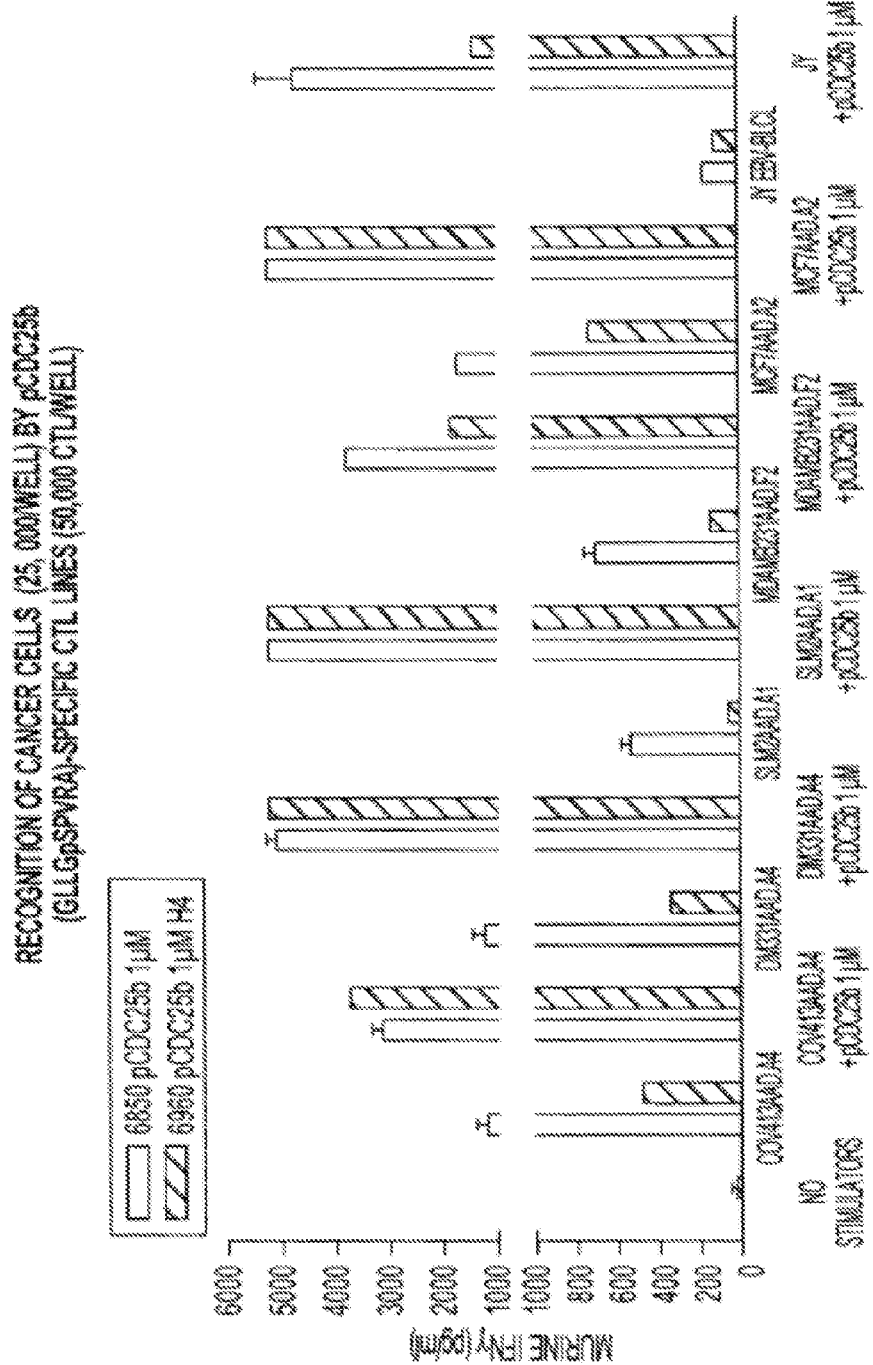

Because the pS33-βcat$_{30}$ epitope identified on melanoma cells is phosphorylated at S33 but not S37, the breadth of expression of β-catenin phosphorylated specifically at S33 (phosphoS33-β-catenin) was evaluated in microarrays of melanoma explants. Both β-catenin and phosphoS33-β-catenin were detected in over 90% of 125 Stage III and IV metastatic melanoma samples (see FIGS. 1A and 1B). Using a quantitative staining index, over 60% of these samples expressed high levels of phosphoS33-β-catenin, and this was inversely correlated with the levels of β-catenin. In normal spleen, liver, and kidney tissues, the levels of phosphoS33-β-catenin and β-catenin were low (see FIGS. 1C and 1D). No association between the levels of phosphoS33-β-catenin or β-catenin and either survival or tumor stage was observed (see FIG. 8) and as depicted in Table 3.

TABLE 3

Expression of PhosphoS33-β-catenin or β-catenin in Stage III and IV Metastatic Melanomas

| | Staining index (×10$^9$) phosphoS33-β-catenin | | | | | total β-catenin | | | | |
|---|---|---|---|---|---|---|---|---|---|---|
| Stage | N | Min | Max | Mean | p value | N | Min | Max | Mean | P value |
| III | 81 | 0.12 | 2.96 | 2.20 | 0.15 | 81 | 0.17 | 2.73 | 1.35 | 0.35 |
| IV | 44 | 0.42 | 2.99 | 2.37 | | 43 | 0.25 | 2.76 | 1.47 | |

The expression of phosphoS33-β-catenin and total β-catenin in 118 Stage III and IV metastatic melanoma samples was evaluated by IHC. The level of expression between the two groups was compared using the Wilcoxon rank sum test. The staining index of each sample was calculated as described in the EXAMPLES 2-16.

However, tumors that had metastasized to other areas of the skin expressed higher levels of phosphoS33-β-catenin than those in lymph nodes as shown in Table 4.

TABLE 4

Metastatic Melanomas in Skin Express Significantly Higher Levels of PhosphoS33-β-catenin than Those in Lymph Nodes

| | Staining index (×10$^9$) phosphoS33-β-catenin | | | | | total β-catenin | | | | |
|---|---|---|---|---|---|---|---|---|---|---|
| Metastatic site | N | Min | Max | Mean | p value | N | Min | Max | Mean | p value |
| Lymph node | 51 | 0.12 | 2.95 | 2.01 | 0.001 | 50 | 0.17 | 2.67 | 1.34 | 0.39 |
| Skin | 67 | 0.42 | 2.98 | 2.47 | | 67 | 2.76 | 0.21 | 1.45 | |

The expression of phosphoS33-β-catenin and total β-catenin in 118 metastatic melanoma samples found in the skin or lymph nodes were evaluated by IHC. The staining index of each sample was calculated as described herein. The level of expression between the two groups was compared using the Wilcoxon rank sum test.

Figure 1E:
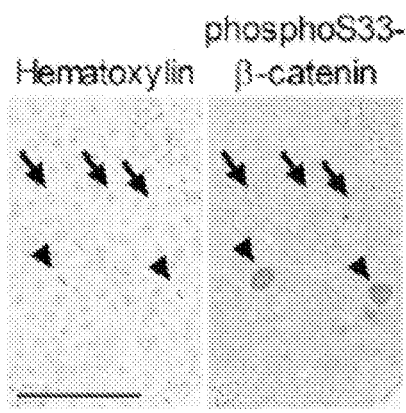

Interestingly, phosphoS33-β-catenin expression in mitotic cells with condensed chromosomes was substantially elevated in comparison with non-mitotic cells (see FIG. 1E) and the staining of the mitotic figures was more intense in samples with moderate to strong phosphoS33-β-catenin expression. This was in keeping with the demonstration that β-catenin accumulates during the cell cycle until G2/M phase after which it is rapidly degraded (Olmeda et al., 2003), and suggested that tumors with a larger fraction of cycling cells or more rapidly dividing cells expressed higher levels of pS33-βcat$_{30}$.

Example 18

Immunogenicity of pS33-βcat$_{30}$

Figure 2A:
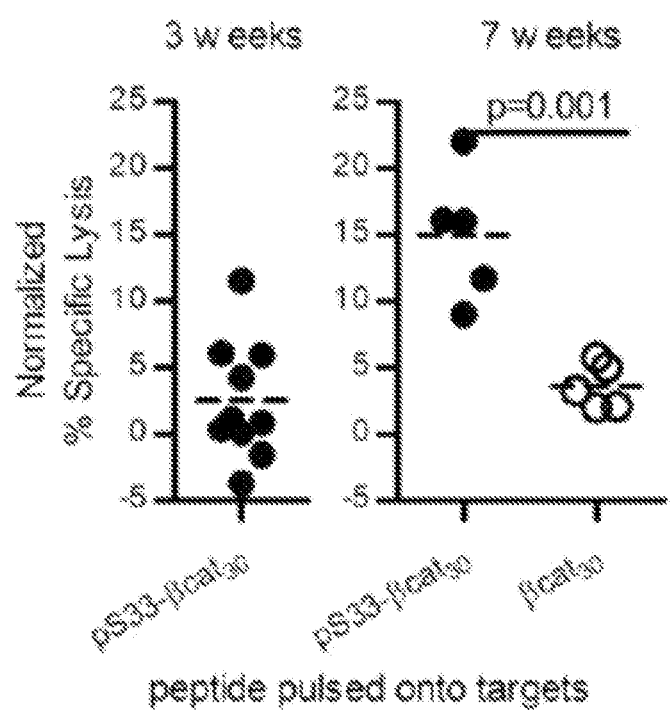
FIGS. 2A-2G are a series of graphs and plots showing modification of the weakly immunogenic pS33-βcat$_{30}$ created a stronger immunogen in mice and humans.

To assess the immunogenicity of pS33-βcat$_{30}$, purified human T cells were cultured with peptide-pulsed stimulators in microwells, and their cytotoxic activity was evaluated after 3-7 weeks. pS33-βcat-reactive T cells were detected in 4 out of 10 wells after 3 weeks of in vitro culture (see FIG. 2A). After seven weeks of culture, these T cells also specifically recognized target cells pulsed with pS33-βcat$_{30}$ but not those pulsed with βcat$_{30}$.

Figure 2B:
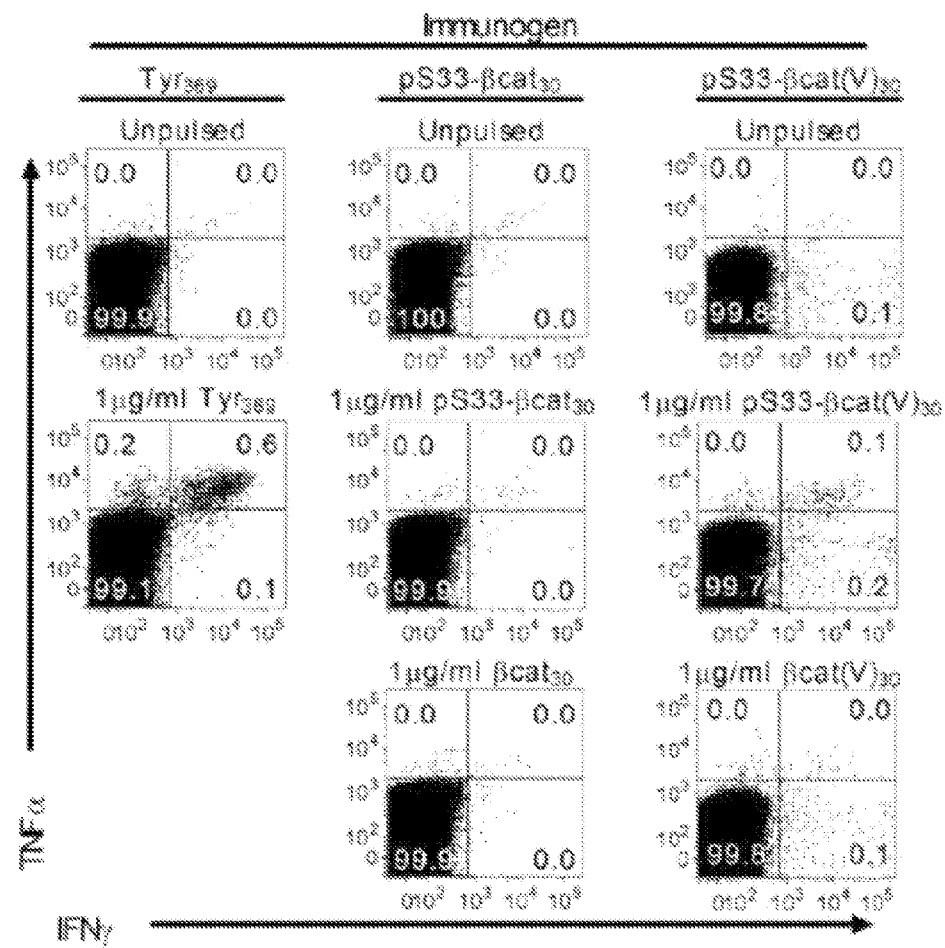
Figure 2C:
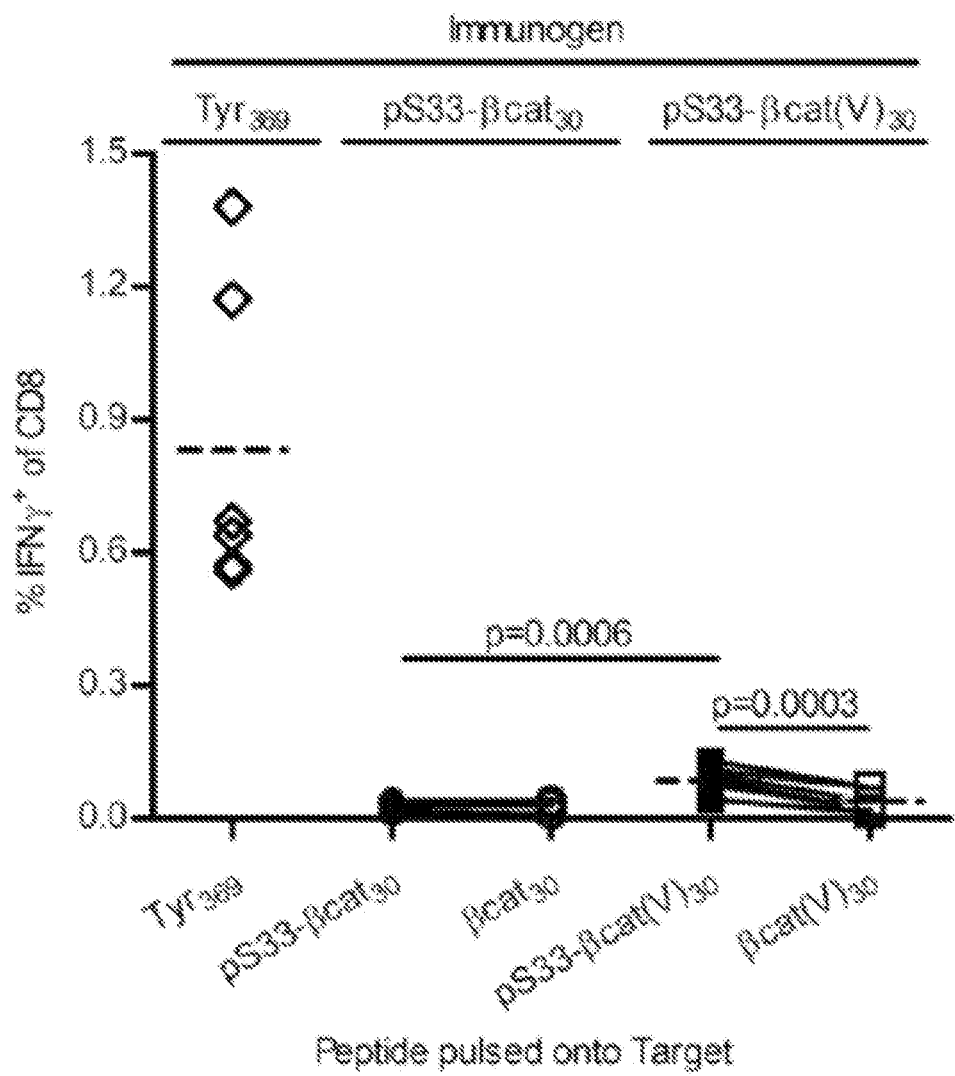
Figure 2D:
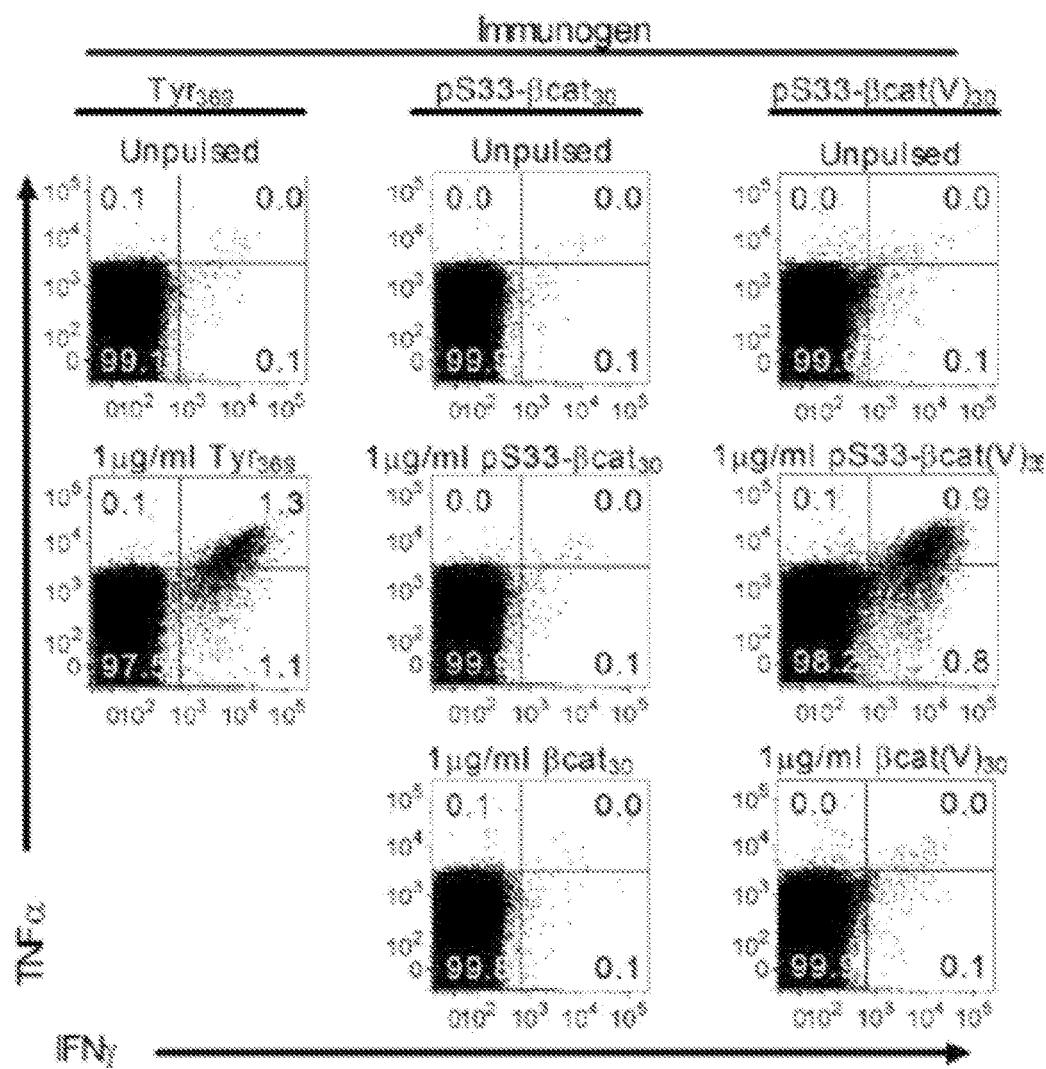
Figure 2E:
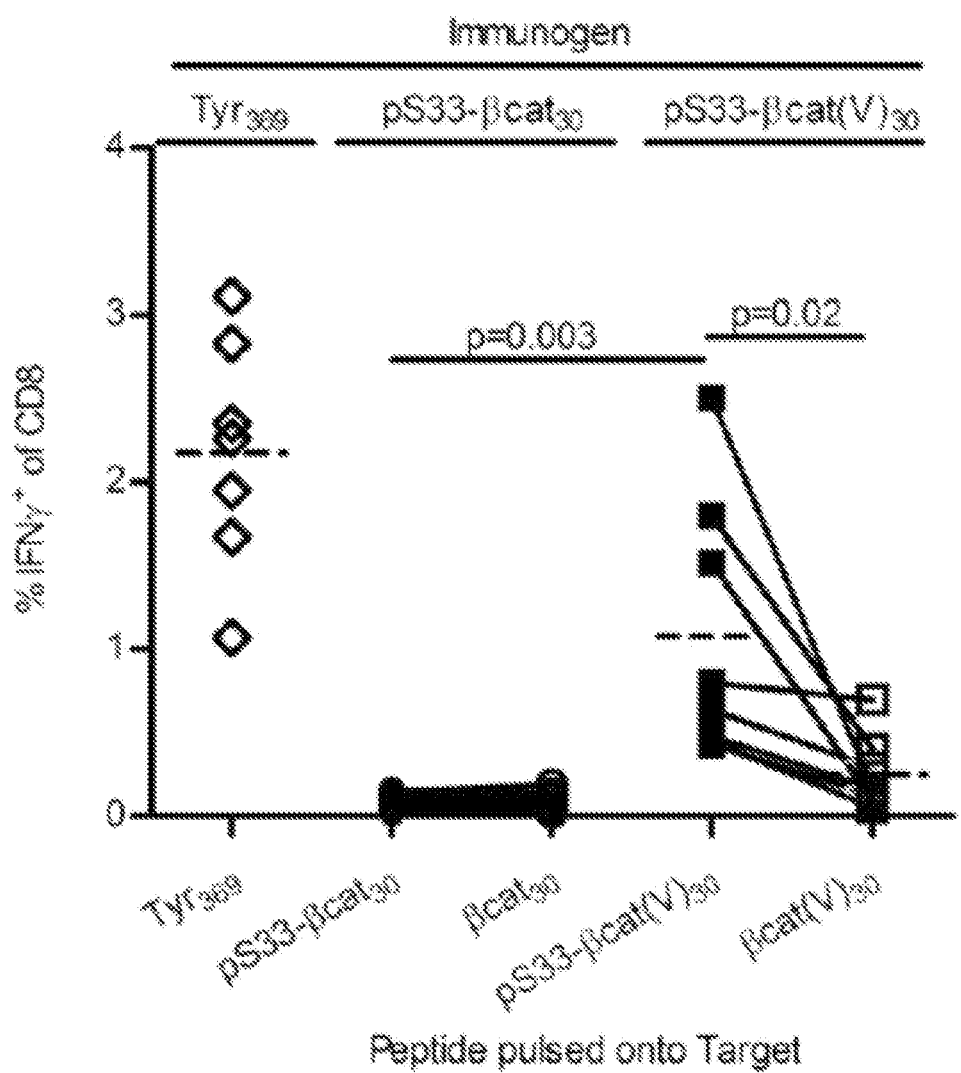

Since the sequences of human and mouse pS33-βcat$_{30}$ are identical, in vivo responses in transgenic mice expressing a recombinant HLA-A*0201 molecule (AAD Tg) were also evaluated. Mice were immunized with pS33-βcat$_{30}$-pulsed bone marrow derived dendritic cells (BMDCs) and IFNγ and TNFα production by CD8 T cells was evaluated ex vivo seven days later. pS33-βcat$_{30}$-specific responses were not discernable (see FIGS. 2B and 2C). Recall responses after boosting with pS33-βcat$_{30}$ plus agonistic anti-CD40 and CpG were also not observed (see FIGS. 2D and 2E). These results demonstrated that pS33-βcat$_{30}$ is a weak immunogen.

Figure 2F:
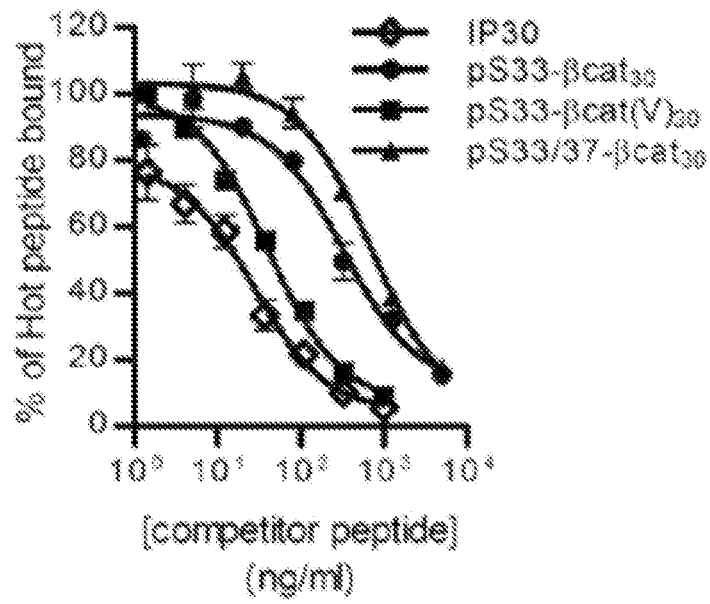
Figure 2G:
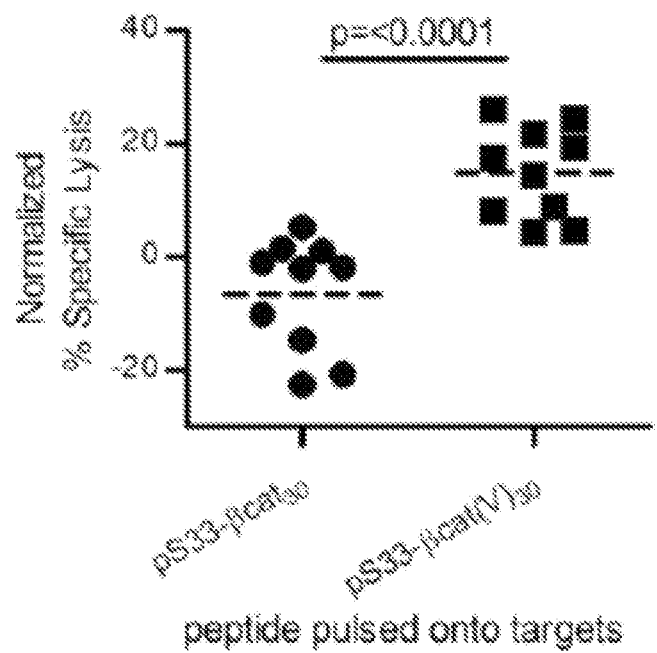

The weak in vivo immunogenicity of pS33-βcat$_{30}$ might be because it binds with low affinity to HLA-A*0201. Indeed, direct measurements indicated that it had a relatively low affinity (see FIG. 2F). The optimal C-terminal anchor residues for HLA-A*0201 binding peptides are leucine or valine (Ruppert et al., 1993), while pS33-βcat$_{30}$ has an alanine at this position. The HLA-A*0201 binding affinity of pS33-βcat$_{30}$ containing a valine in place of the alanine (pS33-βcat(V)$_{30}$) is 8-fold higher than that of pS33-βcat$_{30}$ (see FIG. 2F). Immunization of AAD Tg mice with pS33-βcat(V)$_{30}$ induced discernable primary and memory recall CD8 T cell responses, although these were still weaker than those induced by Tyr369 (see FIGS. 2B-2E). These T cells also specifically recognized the phosphorylated but not the unphosphorylated form of the modified peptide. pS33-βcat(V)$_{30}$ induced measurable in vitro human CD8 T cell responses after only 2 weeks, at which time no specific responses to pS33-βcat$_{30}$ were detected (see FIG. 2G). Thus, modification of pS33-βcat$_{30}$ to enhance its binding affinity for HLA-A*0201 also enhanced its immunogenicity in both humans and mice.

Figure 3A:
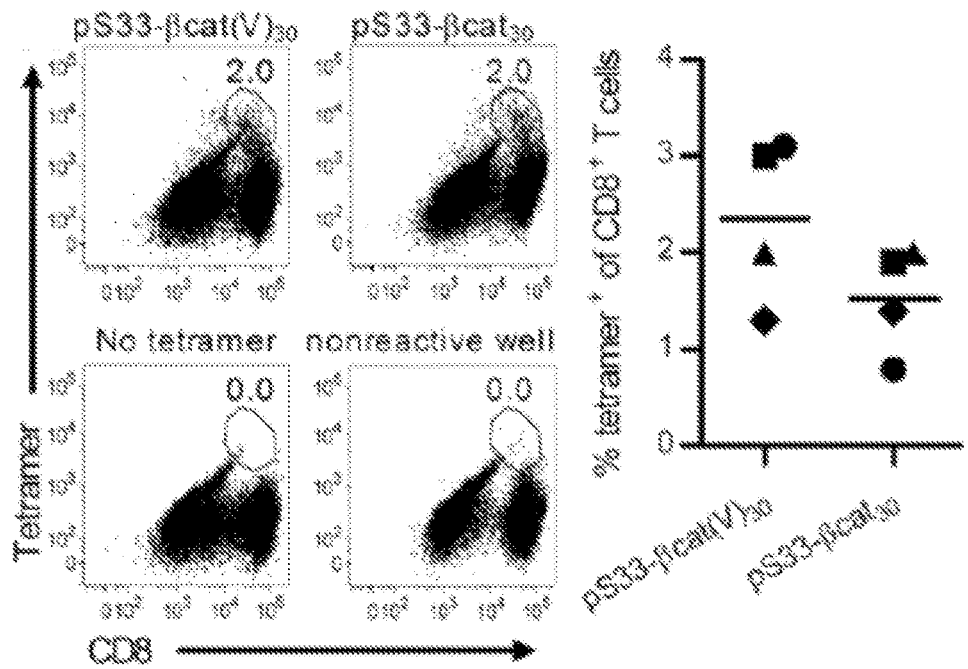
FIGS. 3A-3C show that pS33-βcat(V)-specific human and murine T cells were cross-reactive and antigenically distinct from the natural phosphopeptide.
Figure 3B:
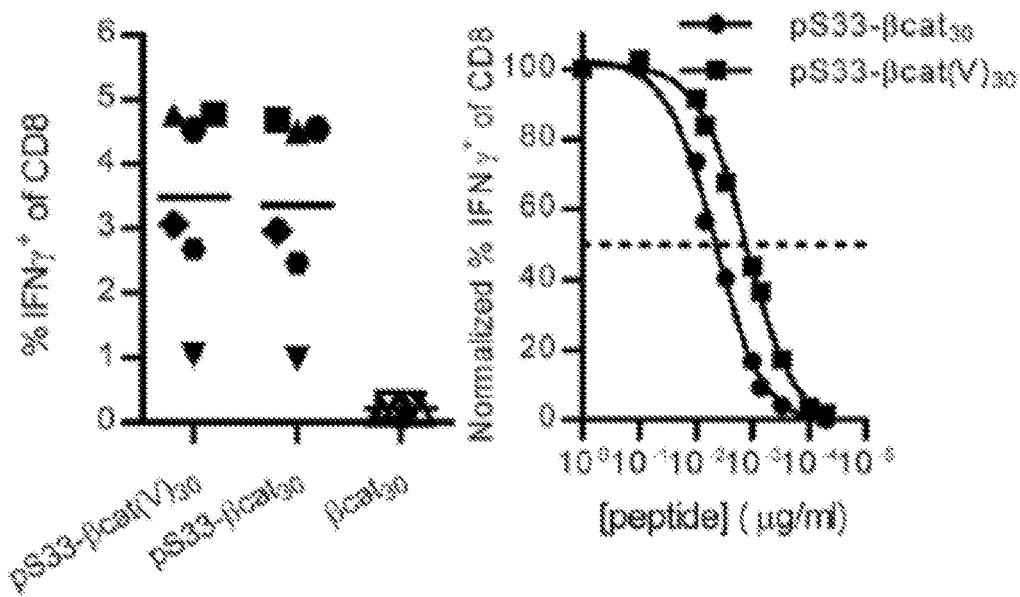

MHC-restricted peptides, even with conservative modifications, can elicit T cells incapable of recognizing the original epitope (Bertoletti et al., 1994; Klenerman et al., 1994). However, in 5 week in vitro cultures with pS33-βcat(V)$_{30}$, the fraction of human CD8$^+$ T cells staining with a pS33-βcat$_{30}$ tetramer (0.8-2%) was 25-100% of that staining with a pS33-βcat(V)$_{30}$ tetramer (1-3%; see FIG. 3A). In addition, 92-100% of freshly isolated pS33-βcat(V)-specific murine T cells recognized stimulators pulsed with the natural phosphopeptide at the maximal dose of 1 μg/ml, demonstrating a high level of crossreactivity against the natural phosphopeptide. More importantly, equivalent T cell recognition was observed at doses of pS33-βcat$_{30}$ that were only 2-5-fold lower than those for pS33-βcat(V)$_{30}$ (see FIG. 3B). Thus, most of the human and murine T cells induced with pS33-βcat(V)$_{30}$ are highly cross-reactive with the natural phosphopeptide.

Figure 3C:
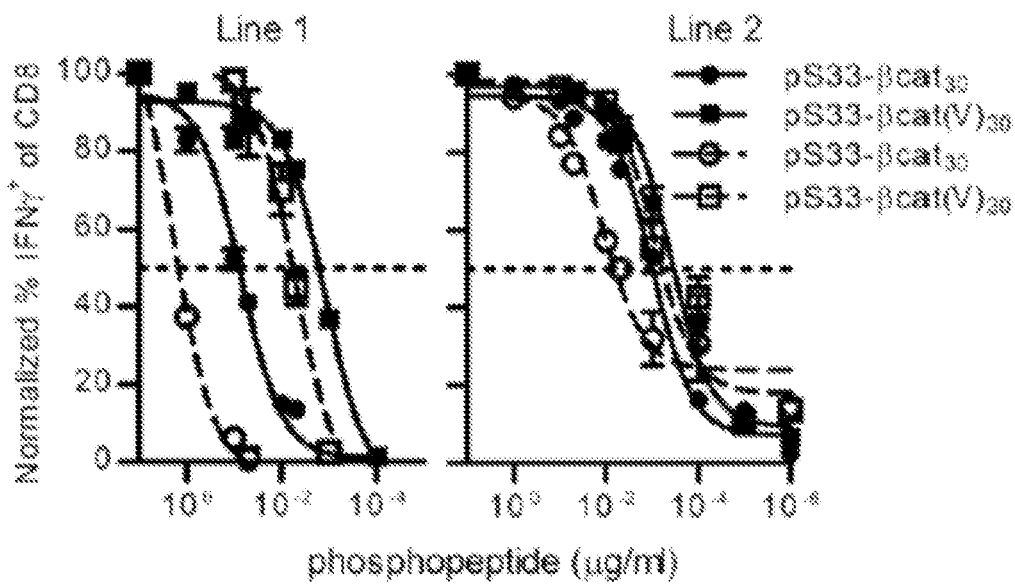

While the differences in dose-response curves for pS33-βcat(V)$_{30}$ and pS33-βcat$_{30}$ were modest (see FIG. 3B), they suggested that the two peptides were nonetheless antigenically distinct. Indeed, it was found that different long-term murine T cell lines varied significantly in the dose-response curves for the natural and modified phosphopeptides. One line (Line 1) showed a 73-fold difference in the dose-response curve for pS33-βcat$_{30}$ and pS33-βcat(V)$_{30}$ (see FIG. 3C, solid lines). While this might have been due to a lower HLA-A*0201 binding affinity and faster off-rate, and thus a lower overall cell-surface density of pS33-βcat$_{30}$, a second T cell line (Line 2) showed almost equivalent recognition of cells pulsed with either phosphopeptide at all concentrations examined (see FIG. 3C, solid lines). In addition, when stimulator cells were pulsed with either phosphopeptide, washed, and incubated for 40 hours prior to the addition of the T cells, the dose response curves for both T cell lines for recognition of pS33-βcat$_{30}$ shifted by 6-10 fold relative to the curves for pS33-βcat(V)$_{30}$ (see FIG. 3C, dashed lines). Thus, both lines were equally sensitive to the enhanced dissociation of pS33-βcat$_{30}$. Thus, despite extensive cross-reactivity, pS33-βcat(V)$_{30}$ was antigenically distinct from pS33-βcat$_{30}$.

Figure 4A:
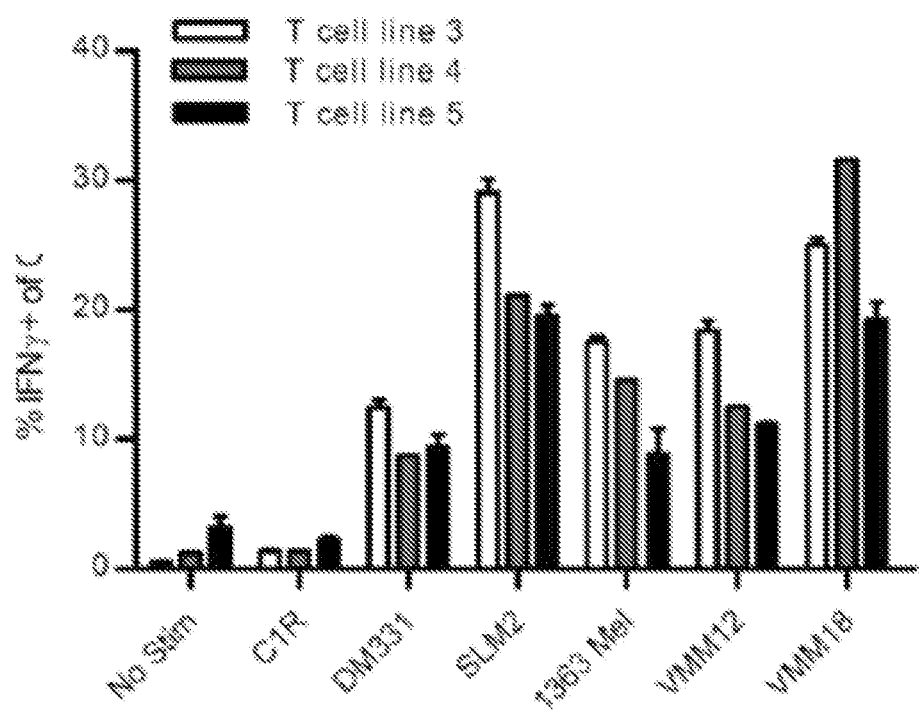
FIGS. 4A and 4B show that pS33-βcat-specific T cells recognized endogenous levels of pS33-βcat$_{30}$ on melanoma cells and control tumor growth. With respect to FIG. 4A, AAD$^+$ melanoma cell lines or C1R, an EBV-transformed B lymphoblastoid cell lines (BLCL), were cultured with three long-term pS33-βcat-specific T cell lines for 5 hours, and intracellular IFNγ production was assayed in triplicate. The T cell cultures showed 70-85% reactivity on pS33-βcat$_{30}$-pulsed targets. Data are representative of two independent experiments. With respect to FIG. 4B, the Upper Panel is a schematic of tumor control experiment. The Lower Panel is a graph showing growth of subcutaneous SLM2 tumors in NOD/SCID IL-2Rγc$^{-/-}$ mice that received IL-2 only or pS33-βcat-specific T cells $^+$ IL-2. Data are representative of two independent experiments with five (5) mice per group. Error bars indicate SEM. Statistical analysis was done by parametric modeling.
Figure 4B:
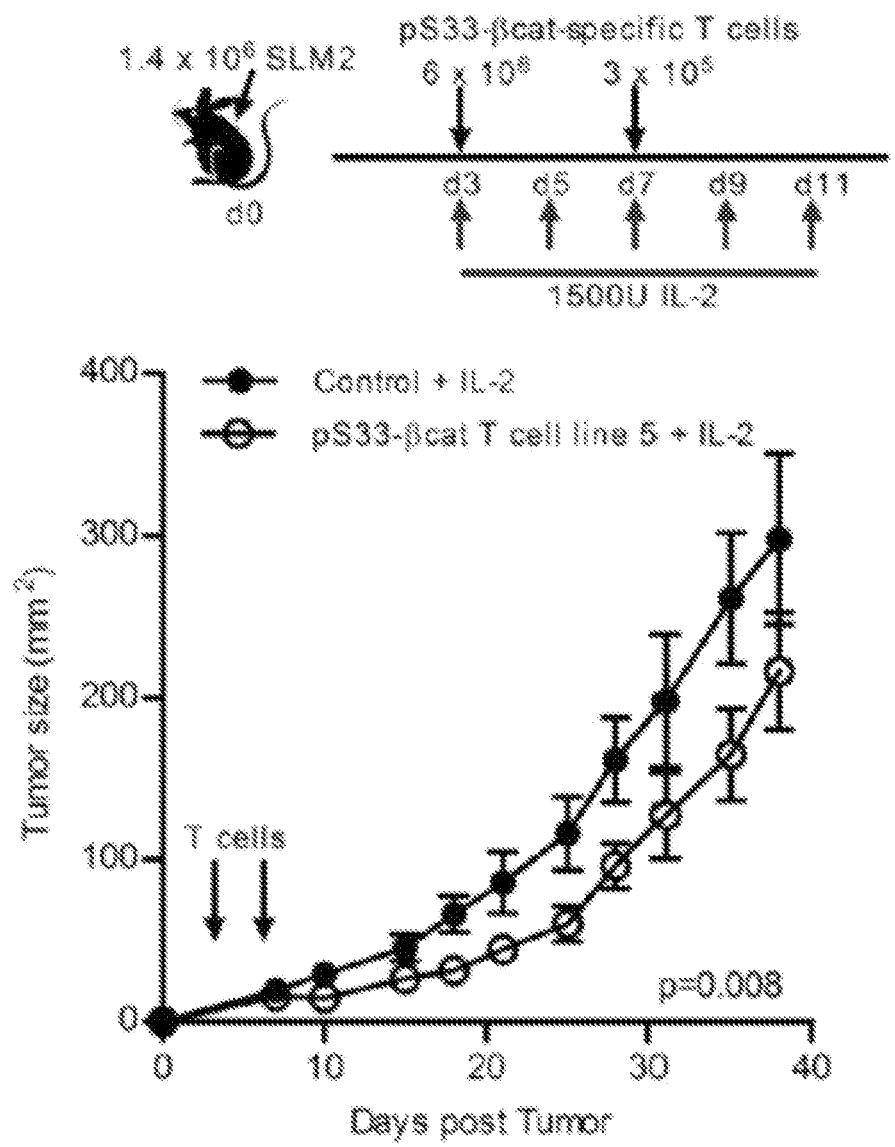

Example 19 pS33-βcat-Specific T Cell Recognition of Melanoma Cell Lines In Vitro and In Vivo Mass spectrometric analysis of two melanoma cell lines, DM331 and SLM2, showed that they display only 0.5-5 copies of pS33-βcat$_{30}$ in association with HLA-A*0201 (Zarling et al., 2006). Nonetheless, these and three additional melanoma cells were recognized by three bulk murine T cell lines (see FIG. 4A). To test the ability of T cells to control tumor growth, T cell line 5 was adoptively transferred into NOD/SCID/IL-2Rγc$^{-/-}$ mice that had been inoculated subcutaneously with SLM2 cells 3 days previously. The pS33-βcat-specific T cells significantly delayed tumor outgrowth (see FIG. 4B). Thus, endogenous levels of pS33-βcat$_{30}$ on melanoma were sufficient for T cell recognition and in vivo tumor control.

Example 20

Control of pS33-βcat$_{30}$ Epitope Display

Figure 5A:
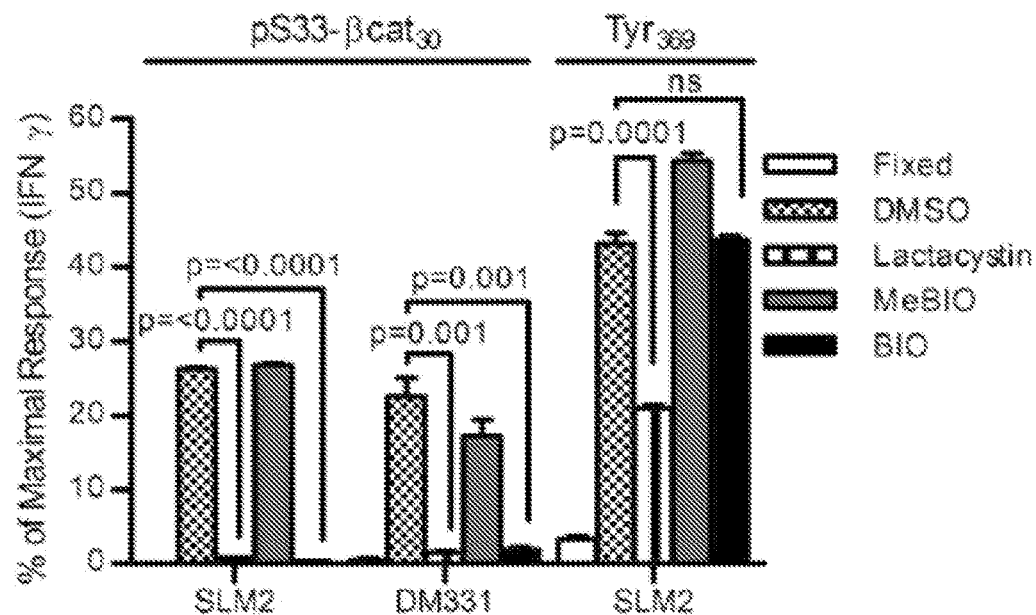
FIGS. 5A-5C present the results of experiments showing that pS33-βcat$_{30}$ was derived from GSK-3 mediated phosphorylation of β-catenin. With respect to FIG. 5A, surface peptide-MHC complexes were denatured from untreated melanoma cells or those pretreated with 5 µM of BIO or MeBIO (an inactive form of BIO) for 4 hours. The cells were then allowed to re-express peptide-MHC molecules in the presence of BIO, MeBIO, or 5 µM lactacystin for 12 hours. T cell recognition of the cells was evaluated after 5 hours incubation with pS33-βcat-specific T cells. Melanoma cells in which surface peptide-MHC complexes were denatured and fixed immediately served as background controls. Data are representative of three independent experiments done in triplicate wells. Error bars indicate SEM. For FIG. 5B, the indicated melanoma cell lines were incubated for 16 hours with 5 µM BIO. During the last 4 hours of treatment, proteasome degradation was blocked with 10 µM Lactacystin (2-(acetylamino)-3-[({3-hydroxy-2-[1-hydroxy-2-methylpropyl]-4-methyl-5-oxopyrrolidin-2-yl}carbonyl)sulfanyl]propanoic acid). The expression of the indicated proteins was assessed by Western blotting with specific antibodies. Data are representative of two independent experiments. With respect to FIG. 5C, free (Top Panel) and MHC-bound (Lower Panel) pS33/37-βcat$_{30}$ molecules were incubated with alkaline phosphatase and the amount of pS33/37-βcat$_{30}$, pS33-βcat$_{30}$, pS37-βcat$_{30}$, and βcat$_{30}$ present was quantified at various time points during the incubation. Data are representative of two independent experiments.
Figure 5B:
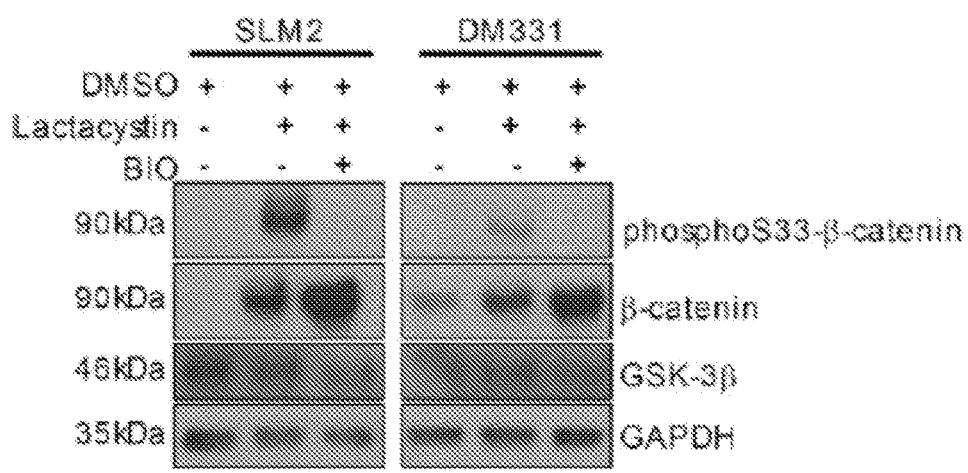

Residue serine-33 (S33) of human β-catenin is phosphorylated by GSK-3β in an obligatory sequence after phosphorylation of serine-41 (S41) and serine-37 (S37), and phosphorylation of both S33 and S37 is required for ubiquitination and degradation of the protein (Kimelman & Xu, 2006). Since pS33-βcat$_{30}$ is phosphorylated at S33 but not S37, the hypothesis that its production was mediated by another kinase was tested. pS33-βcat-specific T cell recognition was abolished when DM331 and SLM2 cells were incubated at low pH to denature peptide-MHC complexes, and then allowed to re-express them in the presence of the proteasome inhibitor lactacystin (see FIG. 5A). Lactacystin treatment also resulted in a substantial increase in the amount of phosphoS33-β-catenin and β-catenin in the melanoma cells (see FIG. 5B). In addition, blockade of GSK-3β activity using the specific inhibitor BIO completely abrogated recognition of melanoma cells by pS33-βcat$_{30}$ T cells (see FIG. 5A) and significantly diminished the amount of phosphoS33-β-catenin in the presence of lactacystin (see FIG. 5B). T cell recognition of Tyr369, an epitope not known to be affected by GSK-3β activity, was unaffected by BIO (see FIG. 5A). These results indicated that although pS33-βcat$_{30}$ lacked a phosphate at S37, it was nonetheless derived from GSK-3β-mediated phosphorylation and proteasomal degradation.

Figure 5C:
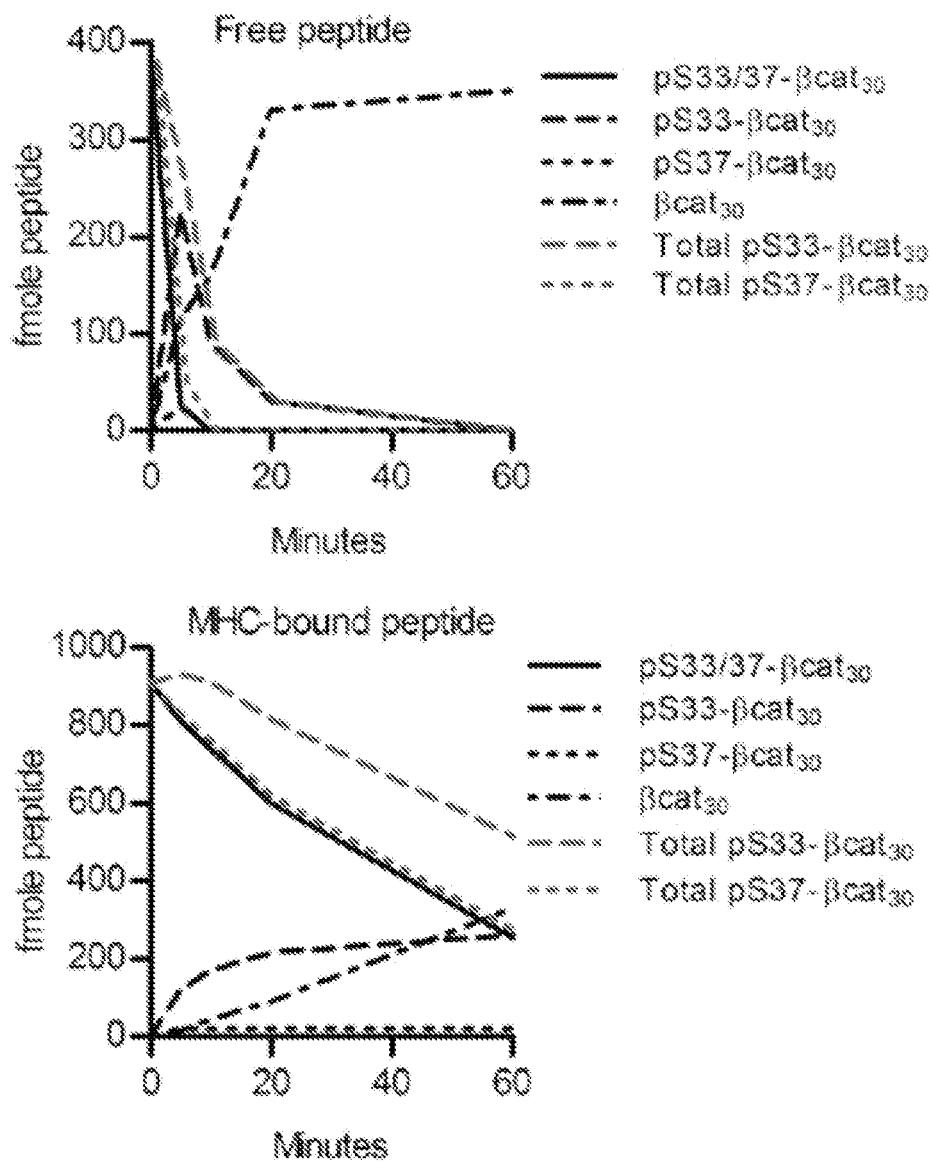

The doubly phosphorylated pS33/pS37-βcat$_{30}$ peptide bound almost as well to HLA-A*0201 as pS33-βcat$_{30}$ (see FIG. 2F) indicating that phosphorylation of S37 was not incompatible with MHC binding. Because pS33 at the P4 peptide position interacts directly with the HLA-A*0201 molecule (Mohammed et al., 2008), the hypothesis that pS37 was more prone to dephosphorylation was also tested. It was found that binding to HLA-A*0201 reduced the rate of dephosphorylation of both S33 and S37 by alkaline phosphatase by more than 10-fold (see FIG. 5C). However, pS37 was more vulnerable to dephosphorylation than pS33, whether the peptide was free or MHC-bound. Collectively, these results suggested that the absence of phosphorylation of S37 was due to its greater sensitivity to cellular phosphatases that act either before or after the phosphopeptide binds to HLA-A*0201.

Figure 6A:
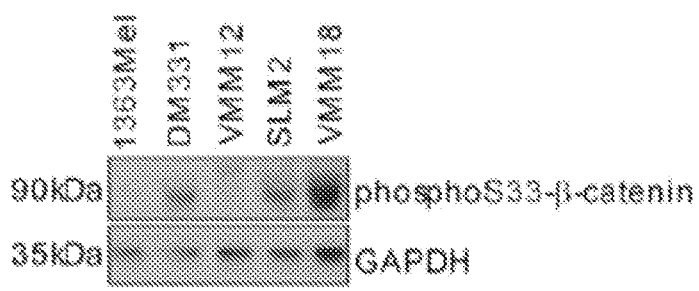
FIGS. 6A-6I show the results of experiments demonstrating that pS33-βcat-specific T cell recognition correlated with total phosphoS33-β-catenin available for degradation and could be predicted by the subcellular localization of β-catenin in melanoma cells.
Figure 6B:
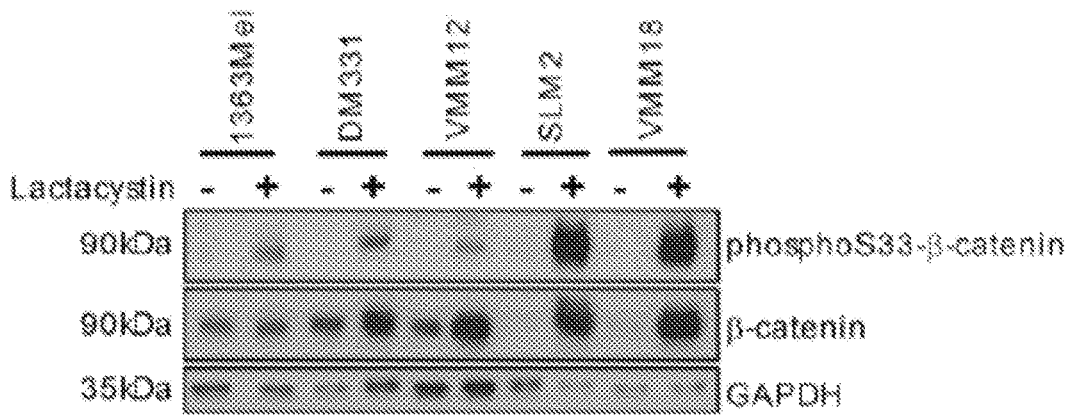
Figure 6C:
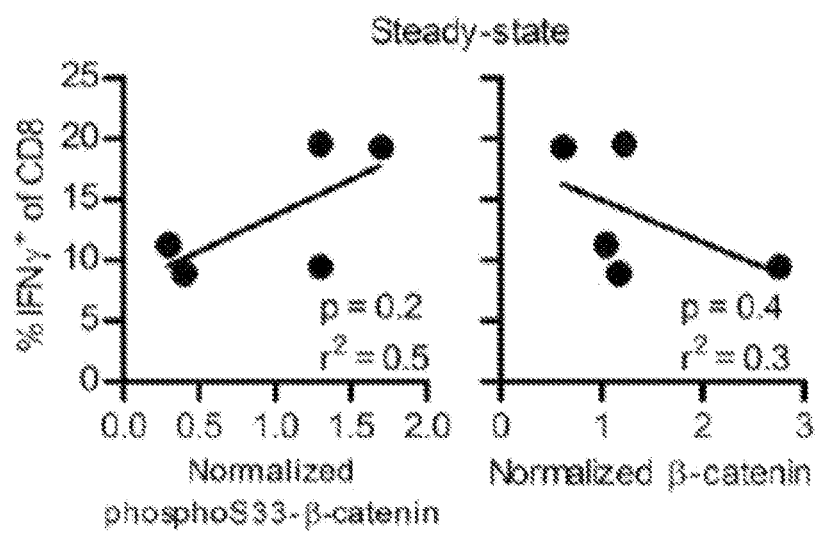
Figure 6D:
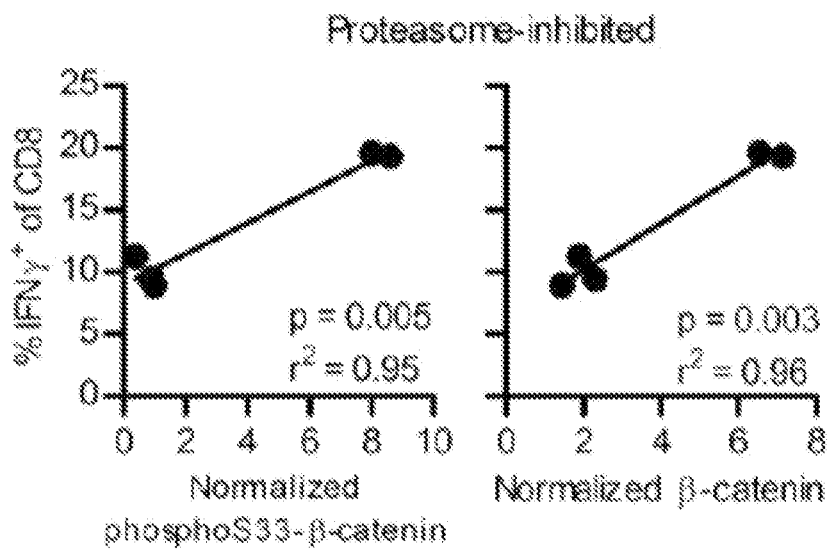

The relationship between the amount of pS33-βcat$_{30}$ displayed and the level of phosphoS33-β-catenin was next evaluated. Surprisingly, a good correlation between the steady state levels of either phosphoS33-β-catenin or total β-catenin was not found in five melanoma cell lines and their level of recognition by pS33-βcat$_{30}$-specific T cells (see FIGS. 6A-6C). However, the extent of T cell recognition did correlate strongly with the amount of phosphoS33-β-catenin and total β-catenin detected when proteasome degradation was blocked (see FIGS. 6B and 6D). While β-catenin localized to the cytoplasm is rapidly phosphorylated and degraded (Kimelman & Xu, 2006), degradation of the protein is limited by nuclear translocation.

Figure 6E:
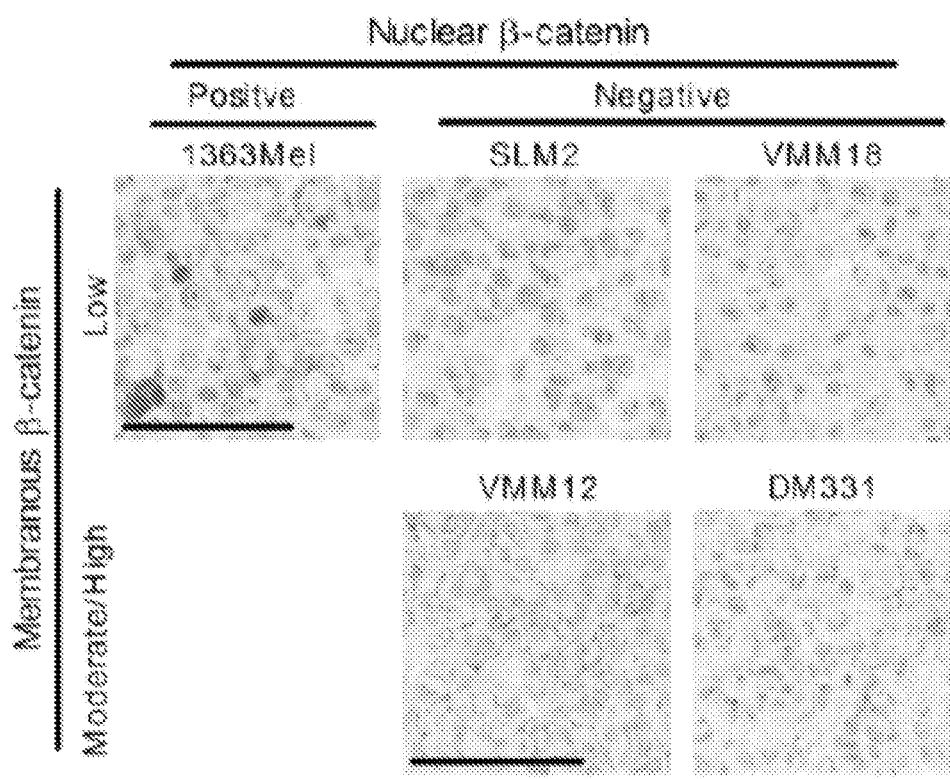
Figure 6F:
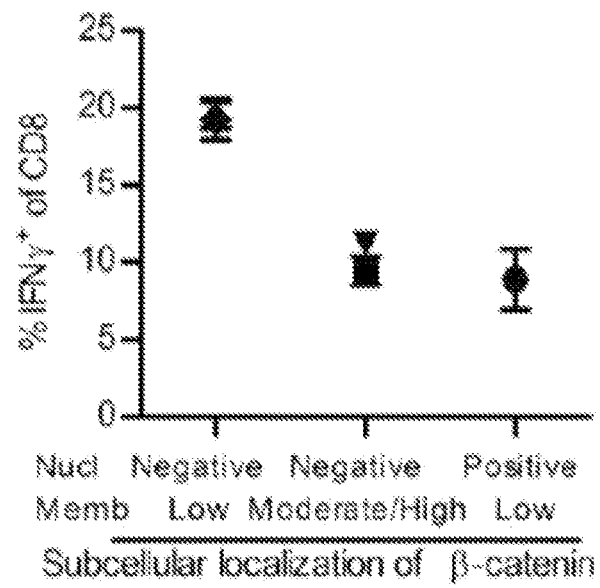
Figure 6G:
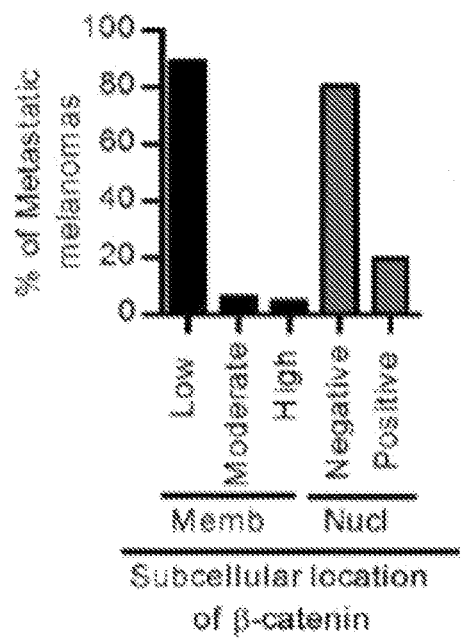

Membrane-associated cadherins compete with APC for binding to β-catenin (Hulsken et al., 1994) and might therefore also limit degradation of β-catenin. Consistent with this hypothesis, T cell recognition (see FIG. 6F) and the level of phosphoS33-β-catenin after proteasome blockade (see FIG. 6A) was lower in cells with moderate to high levels of membranous β-catenin (DM331 and VMM12; see FIG. 6E) or with a significant amount of nuclear β-catenin (1363Mel) than in cells with low levels of both (SLM2 and VMM18). Using the same scoring criteria, over 80% of the 125 samples in the metastatic melanoma microarray expressed low levels of membranous β-catenin and no detectable nuclear expression (see FIG. 6G) suggesting that they had the potential to present sufficient amounts of pS33-βcat$_{30}$ for high level T cell recognition. These results indicated that changes in the regulation of β-catenin degradation based on subcellular localization could have a direct impact on antigen presentation.

Figure 6H:
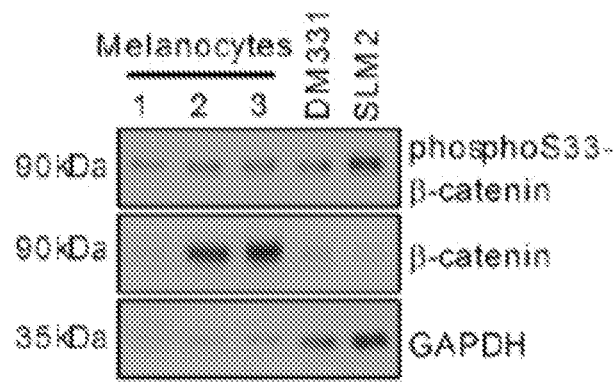
Figure 6I:
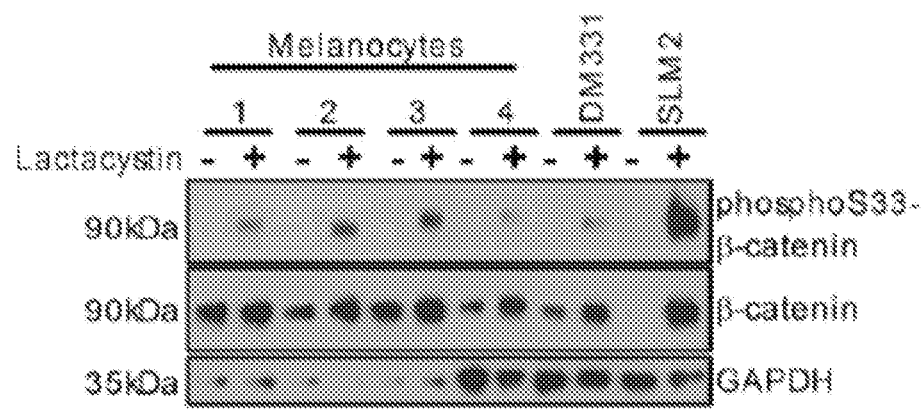
Figure 7A:
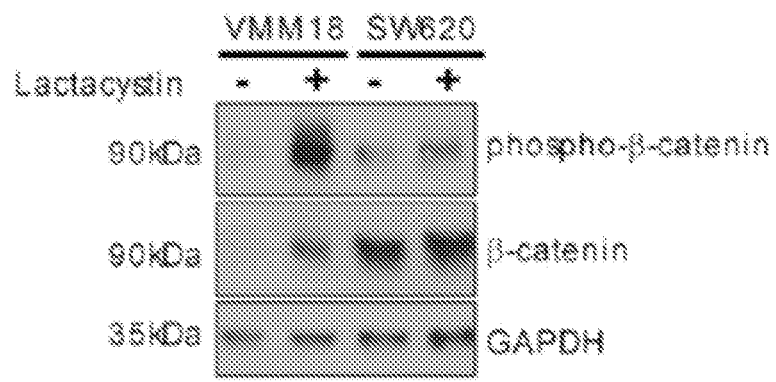
FIGS. 7A-7D show expression of phosphoS33-β-catenin and presentation of pS33-βcat$_{30}$ on other tumor types. Expression of phosphoS33-β-catenin and β-catenin in untreated or Lactacystin-treated melanoma (VMM18 and DM331.
Figure 7B:
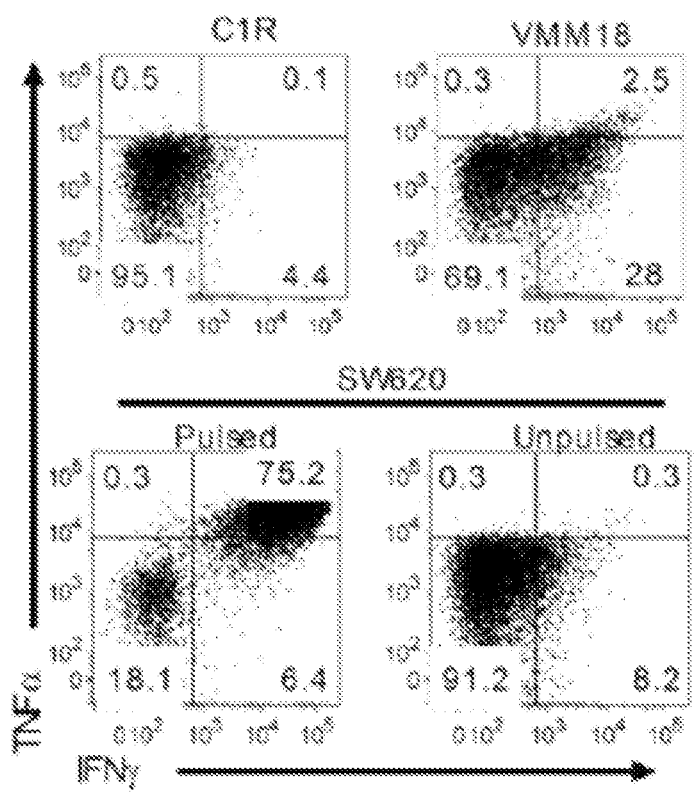
Figure 7C:
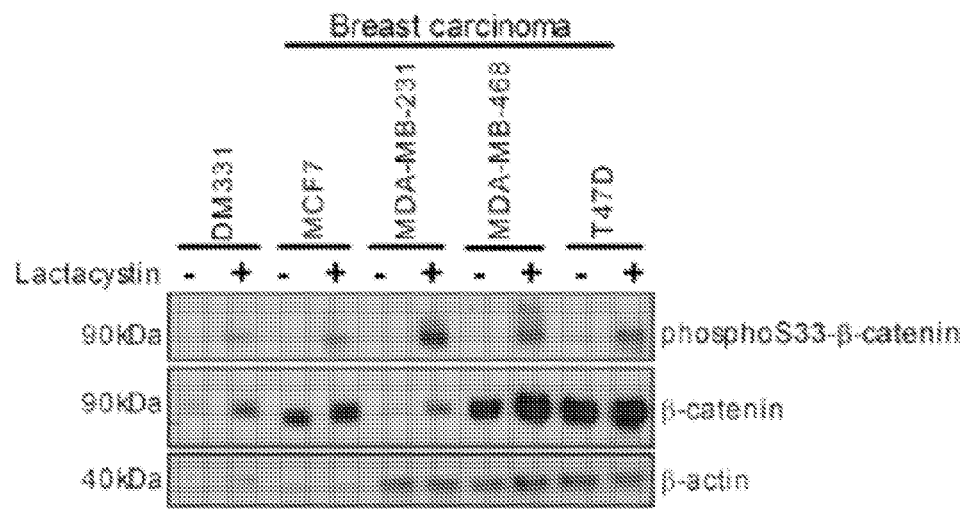
Figure 7D:
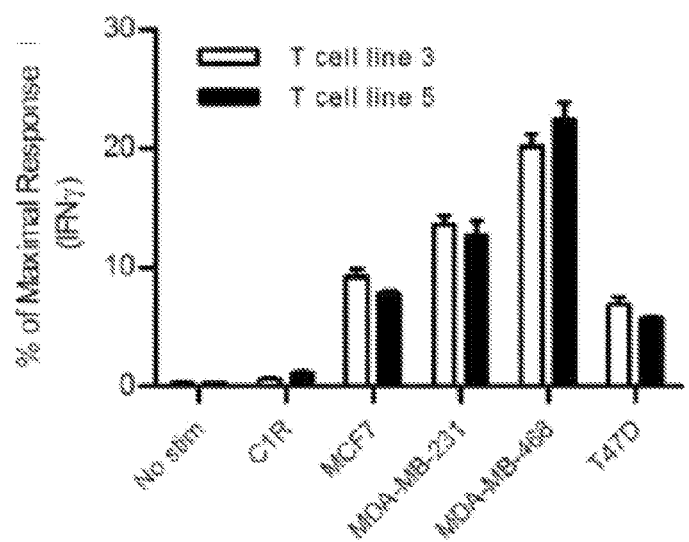

Primary melanocytes cultured in vitro also expressed phosphoS33-β-catenin and total β-catenin in the steady state (see FIG. 6H). The levels of phosphoS33-β-catenin and total β-catenin increased in the cultured melanocytes after Lactacystin treatment indicating that phosphoS33-β-catenin and β-catenin were degraded in cultured melanocytes as well (see FIG. 6I). Notably, the level of phosphoS33-β-catenin and β-catenin expressed in the cultured melanocytes after blockade of proteasome degradation was much lower than in SLM2 but comparable to DM331 and suggested that cultured melanocytes present the pS33-βcat30 phosphoepitope. However, while pS33-βcat30 was detected on SLM2 and DM331 cells, it was not one of the phosphopeptides presented on cultured melanocytes, as shown in Table 5.

TABLE 5

Presentation of Identified Melanoma-associated HLA-A*0201-associated Phosphopeptides on Cultured Melanocytes

| Source protein | Sequence | Copies/cell[a] |
|---|---|---|
| β-catenin | YLDpSGIHSGA (SEQ ID NO: 427) | — |
| Breast cancer anti-estrogen resistance 3 | IMDRpTPEKL (SEQ ID NO: 298) | — |
| Tensin3/Endothelial Marker 6 (TEM6) | VMIGpSPKKV (SEQ ID NO: 426) | — |
| CDC25b | GLLGpSPVRA (SEQ ID NO: 396) | — |
| FAM65A | RTLpSHISEA (SEQ ID NO: 417) | — |
| Jun-C/D | KLApSPELERL (SEQ ID NO: 399) | — |
| TFIID transcription initiation factor subunit 13 | RLFpSKELRC (SEQ ID NO: 409) | — |
| Ribosomal protein S17 | KLLDFGSLpSNLQV (SEQ ID NO: 402) | — |

TABLE 5-continued

Presentation of Identified Melanoma-associated HLA-A*0201-associated Phosphopeptides on Cultured Melanocytes

| Source protein | Sequence | Copies/cell[a] |
|---|---|---|
| Ub-carboxyl terminal hydrolase 10 (USP10) | KLLpSPSNEKL (SEQ ID NO: 403) | — |
| Human bromodomain containing protein-4 | AVVpSPPALHNA (SEQ ID NO: 395) | — |
| FLJ10707 | LMFpSPVTSL (SEQ ID NO: 407) | — |
| Ribosomal protein L4 | ILKpSPEIQRA (SEQ ID NO: 397) | — |
| KIAA1328 protein | KLMpSPKADVKL (SEQ ID NO: 405) | — |
| Interleukin enhancer binding factor 3 (ILF3) | KLFPDpTPLAL (SEQ ID NO: 443) | — |
| Thyroid hormone receptor interacting protein 12 | SLLTpSPPKA (SEQ ID NO: 419) | — |
| Early mitotic inhibitor 1 (Emi1) | VMFRpTPLASV (SEQ ID NO: 425) | — |
| Heterogenous nuclear ribonucleoprotein A0 | AMAApSPHAV (SEQ ID NO: 394) | — |
| Cell cycle checkpoint kinase 1 (CHK1) | KLIDIVpSSQKV (SEQ ID NO: 410) | — |
| Anaphase promoting complex subunit 1 (APC1) | VLLpSPVPEL (SEQ ID NO: 424) | — |
| FLJ22624 | TLApSPSVFKST (SEQ ID NO: 422) | — |
| Mitochondrial escape 1 like 1 (ME1L1) | RLQpSTSERL (SEQ ID NO: 411) | — |
| Insulin receptor substrate 2 (IRS2) | RVApSPTSGV (SEQ ID NO: 418) | +++ |
| β-Synemin | RTFpSPTYGL (SEQ ID NO: 457) | ++ |
| Trafficking protein particle complex 1 (TRAPPC1) | RLDpSYVRSL (SEQ ID NO: 408) | ++ |
| ORF 17, chromosome 2 | RLSpSPLHFV (SEQ ID NO: 412) | +++ |
| Adenosine monophosphate deaminase 2 | RQIpSQDVKL (SEQ ID NO: 414) | ++ |
| Heat shock protein 27 (HSP27) | RQLpSSGVSEI (SEQ ID NO: 415) | +++ |
| Unknown | RLLpSPLSSA (SEQ ID NO: 410) | ++ |
| Nuclear hormone receptor TR2 | RQDpSTPGKVFL (SEQ ID NO: 413) | ++ |
| SRp46 splicing factor | SMpTRSPPRV (SEQ ID NO: 421) | +++ |

[a]—: not detected; ++: 5-50 copies/cell; +++: 50-500 copies/cell.

These data indicated that the amount of phosphoS33-β-catenin and β-catenin degraded in melanocytes was insufficient to produce detectable levels of the phosphoepitope on the cell surface of the melanocytes.

Example 21

Expression of PhosphoS33-β-Catenin and Presentation of pS33-βCat$_{30}$ on Other Tumor Types Because β-catenin has been shown to be functionally important in the development and progression of several cancers, whether pS33-βcat$_{30}$ was presented by tumors other than melanoma was determined. The colorectal carcinoma cell line SW620 expressed high levels of both phosphoS33-β-catenin and total β-catenin, but no change in these levels was observed after proteasome blockade (see FIG. 7A). Additionally, the level of phosphoS33-β-catenin was substantially higher in VMM18 than SW620 after proteasome blockade, indicating that phosphorylation of β-catenin was diminished in SW620. These results were consistent with previous reports of nuclear accumulation and diminished degradation of β-catenin in this colorectal carcinoma cell line due to the expression of a truncated form of APC (Ilyas et al., 1997; Homfray et al., 1998; Crawford et al., 1999; Sadot et al., 2002).

pS33-βcat-specific T cells recognized SW620 cells that had been pulsed with exogenous pS33-βcat$_{30}$. However, despite expressing HLA-A*0201 at a level comparable to that of melanoma cells, unpulsed SW620 cells were not recognized by the T cells (see FIG. 7B), indicating that this colorectal carcinoma cell line presented negligible amounts of pS33-βcat$_{30}$. In contrast, the levels of phosphoS33-β-catenin and total β-catenin increased substantially in four breast cancer cell lines after proteasome inhibition (see FIG. 7C), and these cells were all recognized by pS33-βcat$_{30}$-specific T cells (see FIG. 7D). As such, it appeared that pS33-βcat$_{30}$ would be a good immunotherapeutic target for cancers such as breast and melanoma that rarely exhibit mutations in β-catenin and the destruction complex.

Example 22

Expression of BCAR3, β Catenin, and CDC25b Phosphoproteins in Melanoma and Breast Cancer Assayed Using Tissue Microarrays (TMAs)

Antibodies that recognize the phosphosites for pS1100-IRS2$_{1097-1105}$, pT130-BCAR3$_{127-136}$, pS42-CDC25b$_{38-46}$, anti-pS73-JunC/D$_{70-79}$, and pS33-βcatenin$_{30-39}$ were developed. They have been used to evaluate expression of the phosphosites and their source proteins in human cancer cell lines and pathological specimens using Western blotting, immunofluorescence, and immunohistochemistry.

The IRS-2 source protein phosphorylated at serine-1100 is present in multiple cancer cell lines, including breast, ovarian, colo-rectal, bladder, non-small cell lung cancer, and melanoma, but not normal tissues. In addition, siRNA knockdown of IRS-2 abrogated pS1100-IRS2$_{1097-1105}$-specific T cell recognition and led to cancer cell apoptosis, demonstrating that this protein is critical for cancer cell survival and the source of the class I MHC-restricted phosphopeptide.

Similarly, the phosphorylated forms of BCAR3, β catenin, and CDC25b are broadly expressed among cancer cell lines representing multiple histological types. Expression of these phosphoproteins in melanoma and breast cancer were assayed using tissue microarrays (TMAs). About 80% of the melanomas in TMAs (178 samples of Stage 3 and 4 metastatic melanoma, and about 9 primary melanoma) stained positively for pS33-β-catenin. The majority of the tissues showed cytoplasmic staining, while a small fraction showed additional membranous or nuclear pS33-β-catenin. There were intensely positive pS33-β-catenin staining cells associated with mitotic figures, indicating an association with cell division. The levels of expression of pS1100-IRS-2 and pS33-β-catenin source proteins correlated with the extent of functional recognition by relevant specific T cells.

Example 23

Expression of Phosphorylated Proteins in Cancer Cells and the Level of Phosphoepitope Display at the Cell Surface T cell lines from HLA-A2 transgenic mice that recognized several phosphopeptides have been established, and murine TCR α and β chains from T cells specific for pS1100-IRS2$_{1097-1105}$, pS42-CDC25b$_{38-46}$, pS33-βcatenin$_{30-39}$, and pS429-β-Synemin$_{426-434}$ have been cloned. In vitro transcribed (IVT) RNA encoding these TCR α and β chains have been electroporated into human CD8$^+$ and CD4$^+$ T cells. Expression of mTCR on the surface of up to 90% of cells using an antibody specific for the mouse TCRβ chain was detected. The expression of the mTCR is maintained out to 5 days post-electroporation. Expression of these mTCR maintained phosphopeptide-specific functional recognition based on induction of the release of the effector cytokine IFNγ and initiation of the perforin/granzyme pathway based on cell surface mobilization of CD107a. Importantly, expression of these TCR in human cells enhanced their avidity for peptide pulsed target cells and cancer cells that expressed the phosphopeptides after endogenous processing. Utilizing these mTCR transfected T cells, it was established that the expression of phosphorylated source proteins in cancer cells was directly related to the level of phosphoepitope display at the cell surface. It is expected that such transfected T cells are capable of controlling human melanoma tumors growing as mouse xenografts, for example.

Example 24

Anti-Tumor Vaccines Containing Phosphopeptides

A vaccine having 1.5 ml of emulsion is prepared and 1 ml of this emulsion is administered subcutaneously and intradermally. 1 ml contains 100 μg each of the 3 phosphopeptides and 200 μg of tetanus peptide emulsified in Montanide ISA-51 adjuvant.

Example 25

Evaluations of PBLs in Vaccinated Animals

PBL are evaluated by ELISpot assay for the number of peptide-reactive T cells per $10^5$ cells. PBL are evaluated before vaccination and at several time points during and after the vaccination regimen. The ELISpot assay measures the number of cells releasing IFNγ specifically in response to the vaccination peptides, as recorded by the number of chromogen-defined spots counted directly in the assay wells after exposure of participant lymphocytes to antigen in the presence of solid-phase antibody to IFNγ. The number of spots is compared to two negative controls, one of which is generated by stimulation with an irrelevant peptide. Responder T cells stimulated with PMA, ionomycin, PHA, and/or anti-CD3 are used as a positive control. Assays are performed primarily on lymphocytes sensitized once in vitro. PBL are sensitized with the peptide mixture on day 0, and are assayed using individual peptides at day 14. Patients with reactivity after in vitro sensitization are optionally retested using cryopreserved lymphocytes that have not been sensitized or cultured ex vivo. For measures of T cell response without in vitro sensitization, the ELISpot assay is performed the same way, except that $CD8^+$ cells are isolated first by negative selection on an antibody bead column.

Among participants who have positive immune responses, the number of responding T cells could vary considerably. Therefore, immune response is summarized as a measure of fold-change. For ELISpot assays performed on PBL sensitized to peptide mixture once in vitro, the response to peptide is considered positive if the following criteria are met:

1) the ratio of T cell response to an experimental peptide ($T_{exp\ post}$) to T cell response to a control peptide ($T_{con\ post}$) divided by the ratio of pre-vaccination T cell response to an immunizing peptide ($T_{exp\ pre}$) to pre-vaccination T cell response to control ($T_{con\ pre}$) is at least 2, $$(T_{exp\ post} \div T_{con\ post}) \div (T_{exp\ pre} \div T_{con\ pre}) \geq 2$$

If $(T_{exp\ pre} \div T_{con\ pre}) < 1$, it will be converted to 1 for calculation purposes.

2) the actual number of spots counted for an experimental peptide ($T_{exp\ post}$) is at least 30 (avg spots per $10^5$ cells) greater than the number of spots counted for a negative control ($T_{con\ post}$); and 3) the number of spots counted for an experimental peptide ($T_{exp\ post}$) minus 1 SD is greater than the number of spots counted for the highest negative control ($T_{con\ post}$) plus 1 SD. Depending upon participant allele type, each participant may generate a T cell response against more than one of the synthetic peptides.

The threshold for the number of spots over background (30) represents 30 spots per 100,000 lymphocytes, of which approximately 20% are $CD8^+$ cells. Thus, 30 spots per 100,000 lymphocytes represent approximately 30 spots per 20,000 $CD8^+$ cells (0.15%).

For ELISpot assays performed with cryopreserved fresh lymphocytes, $CD8^+$ cell separation (i.e., negative selection) is performed first. The response to peptide is considered positive if the following criteria are met:

1) the ratio of T cell response to an experimental peptide ($T_{exp\ post}$) to T cell response to a control peptide ($T_{con\ post}$) divided by the ratio of pre-vaccination T cell response to an immunizing peptide ($T_{exp\ pre}$) to pre-vaccination T cell response to control ($T_{con\ pre}$) is at least 2, $$(T_{exp\ post} \div T_{con\ post}) \div (T_{exp\ pre} \div T_{con\ pre}) \geq 2$$

If $(T_{exp\ pre} \div T_{con\ pre}) < 1$, it will be converted to 1 for calculation purposes.

2) the actual number of spots counted for an experimental peptide ($T_{exp\ post}$) is at least 10 (avg spots per $10^5$ CD8 cells) greater than the number of spots counted for a negative control ($T_{con\ post}$), and 3) the number of spots counted for an experimental peptide ($T_{exp\ post}$) minus 1 SD is greater than the number of spots counted for the highest negative control ($T_{con\ post}$) plus 1 SD. Depending upon participant allele type, each participant may generate a T cell response against more than one of the synthetic peptides.

The threshold for the number of spots over background (10) represents 10 spots per 100,000 $CD8^+$ lymphocytes. Thus, 10 spots per 100,000 $CD8^+$ lymphocytes represents approximately 0.01%. Background responses might be lower in these assays than in assays done after one stimulation.

Example 26

Assays of Immune Responses of Lymphocyte Subpopulations to Phosphopeptides

PBL are evaluated for tetramer binding for assessment of immune response of lymphocyte subpopulations to a phosphopeptide. PBL are evaluated before vaccination and at several time points during and after the vaccination regimen. In some embodiments, approximately 200,000 events are acquired by a FACSCALIBUR™ flow cytometer (BD Biosciences) and analyzed by Flowjo software (Tree Star. Inc., Ashland, Oreg., United States of America). An irrelevant tetramer is used as a negative control. Cultured peptide-specific CTL (as determined by Elispot assays) is used as a positive control.

Example 27

PBL Proliferation Assays to Determine Presence of Phosphopeptide-Specific Populations of T Cells PBL are evaluated by a proliferation assay to determine whether T cell phosphopeptide-specific populations are present. PBL are evaluated before vaccination and at several time points during and after the vaccination regimen. Proliferation is measured by the incorporation of [$^3$H] thymidine. The specificity of responding T cells is confirmed using various negative controls, such as but not limited to "no peptide" and/or an irrelevant peptide. Responder T cells stimulated with PMA, ionomycin, PHA, and/or anti-CD3 are optionally used as positive controls.

Example 28

Analysis of $CD45^+$ T Cell Cytokine Profiles

For those patients whose lymphocytes proliferate in response to stimulation with the immunizing phosphopeptides, cytokine profiles of their $CD4^+$ T cells are analyzed and characterized as Th1- or Th2-type cells. $CD8^+$ T cells are optionally depleted from PBL and SIN samples using separation columns (Vancouver, British Columbia, Canada). Cytokine production is measured using the BIO-PLEX™ Multiplex Cytokine Assay (Bio-Rad Laboratories, Inc., Hercules, Calif., United States of America). Cytokines measured include IL-2, IL-4, IL-5, IL-10, TNF-α, and IFNγ. The specificity of responding T cells is confirmed using various negative controls, which optionally include "no peptide" and an irrelevant peptide. Responder T cells stimulated with PMA, ionomycin, PHA, and/or anti-CD3 are optionally used as positive controls.

Example 29

$^{51}$CR Release Assays

The $^{51}$Cr release assay determines the relative killing activity of radioactively labeled target cells as the amount of CPM detected in the supernatant of assay wells after exposure of participant lymphocytes to radioactively labeled targets. Upon killing of the radioactively labeled target cells by the participant lymphocytes, radioactivity is released into the supernatant. Following the incubation period, the residual cells are pelleted and the amount of radioactivity released is determined using a gamma counter. The amount of non-specific release of radioactivity by the target cells is determined as a negative control ($CPM_{MIN}$). Targets lysed with 1 N HCL (to release all radioactivity from cells) are used as a positive control ($CPM_{MAX}$). Assays are performed primarily on lymphocytes sensitized once in vitro. PBL are sensitized with the peptide mixture on day 0, and are assayed using appropriate antigen-expressing HLA-A2$^+$ targets on days 5-7. A net difference of at least or about 10-25%, optionally at least or about 15% Specific Lysis between the positive and negative targets is a threshold for considering an individual culture to be positive for specific cytotoxic activity.

Example 30

Identification and Characterization of Leukemia-Associated MHC Class-I Restricted Phosphopeptides Novel leukemia-associated phosphorylated tumor antigens from primary leukemia samples are identified and immunity against these in both healthy individuals and patients with leukemia is assessed. These data demonstrate how the human CD8$^+$ T cell immune response is able to engage with tumor-associated "neo-antigens" and reveal immunotherapeutic strategies for treating cancer.

To identify naturally processed tumor-associated phosphopeptides, HLA-A*0201(HLA-A2) and HLA-B*0702 (HLA-B7) peptide complexes from four (4) chronic lymphocytic leukemia (CLL) tumor samples, a mantle cell lymphoma sample (MCL), one acute lymphoblastic leukemia (ALL), and an acute myeloid leukemia (AML) sample, in addition to healthy splenic T and B-cells and the cultured lymphoblastoid cell line JY were isolated. These efforts yielded 10 HLA-A2-restricted and 86 HLA-B7-restricted phosphopeptide antigens (see Tables 6 and 7).

TABLE 6

HLA-A*0201 Phosphopeptides Associated with Leukemia Samples

| Gene Name | SEQ ID No. | CLL1 | CLL2 | CLL3 | CLL4 | JY | AML1 | MCL | B Cell | T Cell |
|---|---|---|---|---|---|---|---|---|---|---|
| NCOR2 | 436 | 0 | 1 | 0 | 0 | 0 | 0 | 0 | 0 | 0 |
| LSP1 | 440 | 2 | 2 | 1 | 1 | 2 | 0 | 0 | 0 | 0 |
| N4BP2 | 444 | 0 | 0 | 0 | 1 | 2 | 0 | 0 | 0 | 0 |
| LSP1 | 451 | 2 | 2 | 1 | 1 | 4 | 1 | 1 | 2 | 2 |
| LSP1 | 452 | 2 | 2 | 1 | 1 | 4 | 1 | 1 | 2 | 0 |
| HSPB1 | 456 | 0 | 0 | 1 | 0 | 0 | 0 | 0 | 0 | 0 |
| SYNM | 457 | 0 | 0 | 1 | 0 | 0 | 0 | 0 | 0 | 0 |
| IRS2 | 459 | 1 | 1 | 0 | 0 | 0 | 0 | 1 | 0 | 0 |
| SRSF8 | 460 | 0 | 0 | 1 | 0 | 0 | 0 | 0 | 0 | 0 |
| TNS3 | 464 | 0 | 0 | 0 | 0 | 0 | 0 | 1 | 0 | 0 |

TABLE 7

HLA-B*0702 Phosphopeptides Associated with Leukemia Samples

| Gene Name | SEQ ID No. | ALL1 | CLL2 | CLL4 | HCL1 | JY | AML1 | BM | B Cell | T Cell |
|---|---|---|---|---|---|---|---|---|---|---|
| ARHGAP17 | 267 | | | | | | 1 | | | |
| HMGN1 | 269 | | | | | | 1 | | | |
| MLL | 270 | | | | | | 1 | | | |
| RBM14 | 272 | | | | | | 2 | | | |
| RBM14 | 273 | | | | | | 4 | | | |
| SON | 274 | 4 | | | | | | | 2 | 2 |
| GPSM3 | 277 | | | | | | 4 | | | |
| GPSM3 | 278 | | | | | | 3 | | | |
| MAP1A | 282 | 1 | 1 | | 1 | 1 | | | | |
| ZC3H14 | 283 | | | | | | 2 | | | |
| MYC | 284 | 4 | | | | | | | | 2 |
| MORC2 | 285 | 1 | | | | | | | | |
| BCL11A | 287 | 3 | | | | | | | | 2 |
| SPEN | 287 | 3 | | | | | | | 1 | 2 |
| CCDC45 | 288 | 2 | 1 | | 2 | 2 | 1 | | | |
| TBC1D10C | 289 | 1 | | | 1 | | | | | |
| MACF1 | 291 | 1 | 1 | 1 | 1 | | | | | |
| GRK2 | 295 | 2 | 4 | 4 | 4 | 4 | 4 | | | |
| NFATC2 | 296 | 2 | 1 | | 2 | 4 | | | 2 | 3 |
| MAP7D1 | 297 | | | | | | 1 | | | |
| GFI1 | 302 | | | | | | 3 | | | |
| LSP1 | 303 | | | | | | 3 | | | |
| LSP1 | 304 | | | | | | 4 | | | |

TABLE 7-continued

HLA-B*0702 Phosphopeptides Associated with Leukemia Samples

| Gene Name | SEQ ID No. | ALL1 | CLL2 | CLL4 | HCL1 | JY | AML1 | BM | B Cell | T Cell |
|---|---|---|---|---|---|---|---|---|---|---|
| SRRM2 | 305 | 4 | | | | | | | 1 | |
| ARHGAP30 | 306 | 2 | 2 | | 1 | 4 | | | 2 | 3 |
| MEF2D | 307 | 4 | 2 | | 2 | 4 | 1 | 1 | 1 | 3 |
| C6orf64 | 308 | 1 | 3 | 2 | 2 | 4 | 2 | | | |
| KIAA1310 | 309 | 2 | 2 | 1 | 1 | 4 | 1 | | 1 | 1 |
| — | 310 | 1 | | | | | | | | |
| SETD2 | 312 | 2 | 1 | | 1 | 4 | 2 | | | |
| LUZP1 | 313 | 4 | 4 | 4 | 4 | 4 | 3 | | 4 | 4 |
| LUZP1 | 313 | 2 | 1 | | | 2 | 1 | | | |
| C17orf85 | 314 | 1 | 1 | | 1 | 3 | 1 | | | |
| PPP1CA | 315 | 1 | | | | | | | | |
| EP300 | 317 | | | | | | 1 | | | |
| PCBP2 | 318 | 2 | 1 | | | | | 1 | | |
| TLK1 | 319 | 1 | 3 | 2 | 1 | 4 | | | 1 | 1 |
| KLF2 | 320 | 1 | | | | | | | | |
| SCAP | 321 | 2 | 1 | 1 | 1 | 4 | | | | 2 |
| RERE | 322 | 3 | 1 | | 1 | | | | 2 | 2 |
| MYL9 | 323 | 4 | 4 | 4 | 4 | 4 | 2 | | 2 | 4 |
| MYL9 | 324 | | | | | | 2 | | 2 | 3 |
| RREB1 | 325 | | | | | | 2 | | | |
| MIIP | 327 | | | | | | 2 | | | |
| SIK1 | 328 | | | | | | 1 | | | |
| AKAP13 | 330 | | | | | | 2 | | | |
| MEFV | 331 | | | | | | 1 | | | |
| ZNF219 | 333 | | | | | | 1 | | | |
| GTF2IRD1 | 334 | | | | | | 1 | | | |
| ATXN2 | 336 | | | | | | 2 | | | |
| GRM5 | 337 | | | | | | 2 | | | |
| RBM17 | 338 | | | | | | 4 | | | |
| RBM17 | 339 | | | | | | 2 | | | |
| SYNPO | 342 | | | | | | 2 | | | |
| ARID1B | 343 | 4 | 2 | | 1 | 3 | 2 | | 3 | 4 |
| TSC22D4 | 344 | 1 | 1 | 1 | 1 | | 1 | | | |
| NCOA1 | 346 | 2 | 2 | 2 | 2 | 4 | 2 | | 2 | |
| — | 347 | 3 | 2 | 2 | 3 | 4 | 2 | | 3 | 3 |
| HIVEP2 | 348 | 1 | | | | | | | | |
| KLF10 | 349 | 4 | 2 | | 1 | 4 | | | 2 | 2 |
| SKI | 350 | 1 | | | 1 | 1 | | | | |
| FAM53C | 351 | 2 | | | | 2 | 2 | | 2 | 2 |
| MKI67IP | 352 | | | | | | 4 | | | |
| LPP | 356 | | | | | | 1 | | | |
| IP6K1 | 358 | 1 | | | | | | | | |
| KIAA0889 | 359 | 1 | | | | | | | | |
| RBM15 | 360 | 1 | | | | | | | | |
| VPS13D | 361 | 2 | | | | | | | 1 | 1 |
| AKAP13 | 363 | 1 | | | | | | | | |
| MLL | 366 | | | | | | 2 | | | |
| ATXN2L | 367 | 1 | 1 | 1 | 1 | 4 | | | | |
| CCDC88B | 368 | | | | | | 1 | | | |
| ZFP106 | 370 | | | | | | 1 | | | |
| RCSD1 | 371 | 1 | 3 | 3 | 2 | 4 | 1 | 1 | | 1 |
| SFRS7 | 374 | | | | | | 4 | | | |
| — | 377 | 1 | 1 | 2 | 2 | 4 | 2 | | | |
| CHAF1A | 379 | | | | | | 2 | | | |
| ANKRD17 | 382 | | | | | | 2 | | 2 | 2 |
| C1orf63 | 383 | | | | | | 1 | | | |
| TPX2 | 385 | 1 | | | | | | | | |
| RUNX1 | 386 | 1 | | | | | | | | |
| MAP3K11 | 387 | | 3 | 2 | 3 | 4 | 3 | | | |
| MAP3K11 | 388 | | 2 | 2 | 2 | 4 | 3 | | | |
| SVIL | 389 | | | | | | 1 | | | |
| GIGYF2 | 391 | | | | | | 1 | | | |
| GIGYF2 | 392 | | | | | | 2 | | | |

Tables 6 and 7 provides listings of HLA-A*0201 and HLA-B*0702 phosphopeptides associated with leukemia samples. In Tables 6 and 7, the following abbreviations are employed: CLL—Chronic Lymphocytic Leukemia; MCL—Mantle Cell Lymphoma; AML—Acute Myeloid Leukemia; ALL—Acute Lymphoblastic Leukemia; HCL—Hairy Cell Leukemia; B-LCL—EBV Transformed B Lymphoblastoid Cell Line (JY). In each of columns 3-12, no number indicates Not Detected; 1 indicates <1 copy/cell, 2 indicates 1-5 copies/cell, 3 indicates 6-25 copies per cell, and 4 indicates >25 copies per cell. Lowercase s, t, and y in the sequences correspond to serine-, threonine-, or tyrosine-associated phosphorylated residues, respectively.

Due to the greater number of HLA-B7-restricted phosphopeptide antigens identified, the distribution of phosphopeptides between tumor types and healthy tissue was analyzed (see FIG. 10A). For all tissue types a greater number of phosphopeptides were identified for HLA-B7 than HLA-A2 (see FIG. 10B), with more phosphopeptides identified on the aggressive tumors (AML and ALL) than other indolent tumors (CLL) or normal counterpart tissue (see FIG. 10C).

The 57 AML-associated phosphopeptides were derived from a number of interesting oncogenes, many of which have been directly implicated in leukemogenesis, such as BCL-11A, MYC, RUNX1, EP300, SKI, GFI1 and MLL (see Tables 6 and 7 herein above). Forty-six phosphopeptides were identified on the ALL tumor sample whereas a total of 28 phosphopeptide antigens were identified on the surface of two CLL tumor samples (see FIG. 10A). Of 57 HLA-B7 AML-associated peptides, only two were on healthy human bone marrow samples, 36 of these were only observed on the AML sample and no other tumor samples (see FIG. 10B). Sixteen phosphopeptide were shared between ALL, CLL and AML primary tumor samples with 8/16 not observed on healthy tissue. Of the 46 ALL-associated phosphopeptides, 19 were ALL-specific with 13 of these not observed on T- or B-cells. These results identified a large cohort of phosphopeptides shared by multiple leukemic malignancies but not expressed on normal tissue that are potential immunotherapeutic candidates.

Example 31

Characteristics of HLA-A2- and HLA-B7-Bound Phosphopeptides

Figure 10D:
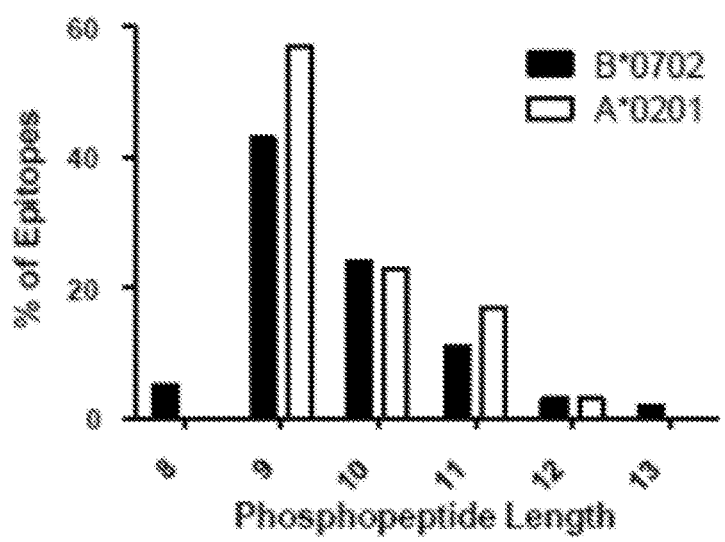
Figure 10E:
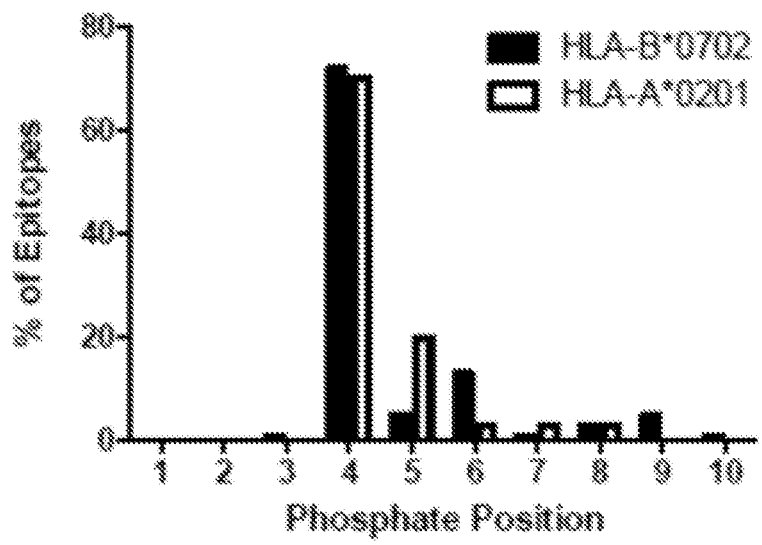

Of the 86 HLA-B7-restricted phosphopeptides, five (6%) were 8-mers, 41 (48%) 9-mers, 24 (28%) 10-mers, 11 (13%) 11-mers, and five (6%) either 12- or 13-mers were similar in length to the identified HLA-A2 phosphopeptides (see FIG. 10D). All phosphopeptides were monophosphorylated, except two dual phosphorylated peptides, with 79/88 (90%) bearing phosphoserine and 9 phosphothreonine residues. No phosphotyrosine residues were observed. The phosphate group was notably constrained to position four in 62/86 (72%) of HLA-B7 phosphopeptides a similar proportion to the HLA-A2 phosphopeptides (see FIG. 10E).

Figure 10F:
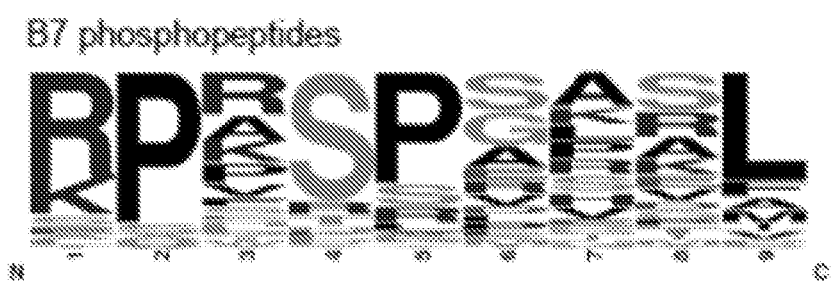
Figure 10G:
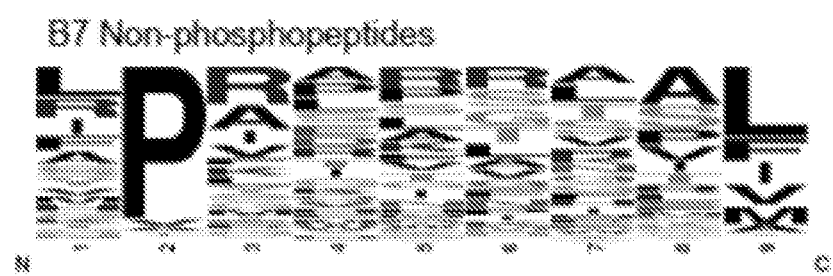

Examination of the B7-restricted phosphopeptides identified several unusual features not seen in non-phosphorylated B7-restricted peptides. Comparison of the 41 9-mer B7-restricted phosphopeptides (see FIG. 10F) against 1038 9-mer peptides contained within the Immune Epitope database (the website address is iedb[dot]org; see FIG. 10G) revealed that 80% of phosphopeptide P1 residues were basic compared with 17% for non-phosphorylated HLA-B7-restricted peptides (p<0.001; $\chi^2$ test). This bias also extended into 10-mers and 11-mers. Common features between non-phosphorylated and phosphorylated epitopes were a strong preference for proline at P2 anchor and other C-terminal anchor residues (see FIGS. 10F and 10G).

An additional feature of B7-bound phosphopeptides was the bias toward proline at P5, with 63% of 9-mers bearing this residue at P5. The ImmuneEpitope dataset contained only 9% proline residues at P5.

Figure 10H:
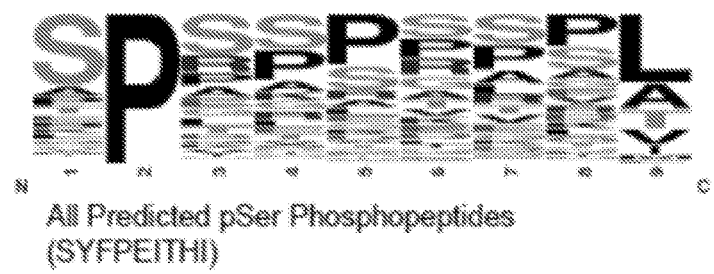
Figure 10I:
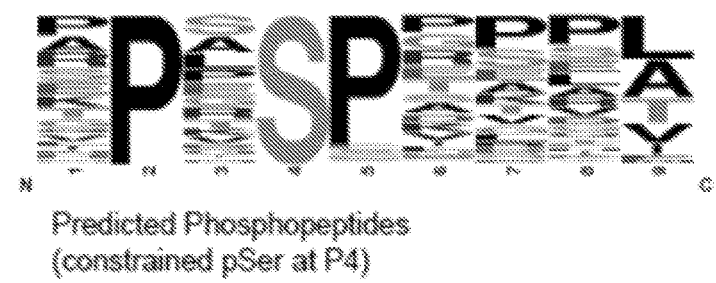

Whether this bias was imposed by the underlying common kinase motif such as PXSP was also evaluated in silico using the PHOSPHOSITE® Protein Modification Resource database (the website address is phosphosite[dot]org), where the known phosphoserine-containing 9-residue peptide regions were selected using the SYFPEITHI Database for MHC Ligands and Peptide Motifs (the website address is sfpeithi[dot]de), using a threshold score of 20 (78% of all 9-mer HLA-B7 phosphopeptides scored at least 20). The position of the phosphoserine within 1031 phosphopeptides predicted to bind to HLA-B7 were not skewed towards P4 (see FIG. 10H). However, of the 164 predicted phosphopeptide epitopes that had phosphoserine at P4, 87% contained a proline at P5 (see FIG. 10I). This suggested that the P5 proline bias reflected an underlying kinase motif rather than being imposed by HLA binding. However, the P1 and P4 biases seemed to reflect roles in binding to HLA-B7.

Example 32

Generation of Phosphopeptide-Specific T Cells in Healthy Donors

Figure 11A:
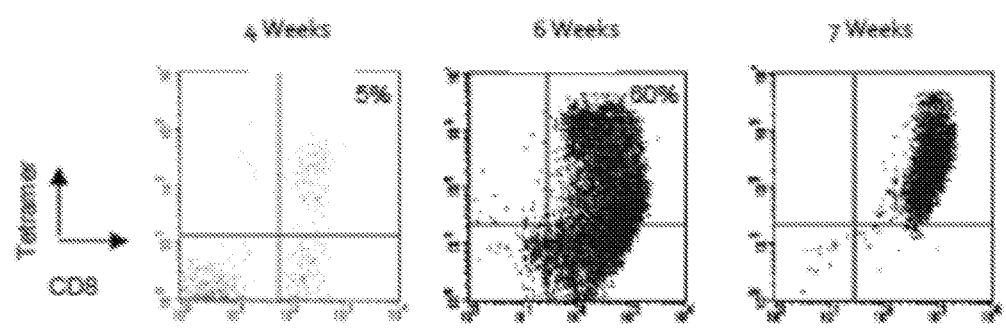
FIGS. 11A-11G summarize generation of phosphopeptide-specific T cells. With respect to Fig. 11A, following dendritic cell stimulation ex vivo, HLA-A2 RQA(pS)IELPSMAV (SEQ ID NO: 452)-specific T cell lines could be generated from healthy donors. HLA-phosphopeptide tetramers were used to select RQA(pS)IELPSMAV (SEQ ID NO: 452)-specific T cells between re-stimulation rounds. These T cells were able to recognize RQA(pS)IELPSMAV (SEQ ID NO: 452)-loaded targets, but not those loaded with unphosphorylated RQA-V (SEQ ID NO: 2375) nor other phosphorylated A2-restricted phosphopeptides (see FIG. 11B, RVASPTSGV (SEQ ID NO: 418; RVA(pS)PTSGV (SEQ ID NO: 418; KLIDRTESL (SEQ ID NO: 440); KLIDRTE(pS)L (SEQ ID NO: 440); RQA(pS)IELPSM (SEQ ID NO: 248); RQASIELPSM (SEQ ID NO: 248); RQA(pS)IELPSMAV (SEQ ID NO: 452); RQASIELPS-MAV (SEQ ID NO: 452)). The RQA(pS)IELPSMAV (SEQ ID NO: 452)-specific T cell lines were able to recognize tumor cell lines, both HLA-A2+ EBV-transformed lymphoblastoid cells, JY and FFLuc, but also the A2+ AML cell line THP-1 (see FIG. 11C). The ALL cell line, Jurkat, was only recognized when transfected with A2. Expanded RQA(pS)IELPSMAV (SEQ ID NO: 452) T cell lines are also able to kill JY and FFLuc tumor cells in addition to HLA-A2 transfected Jurkat (see FIG. 11D). Ex vivo cytotoxicity was also demonstrated against HLA-A2+ primary AML and CLL cells, but not against HLA-A2− primary CLL cells (see FIG. 11E). Similarly, both anti-HLA-B7 pNCOA1 and pMYL9-specific T cells grown from healthy donors were able to kill three different primary CLL cells ex vivo (see FIGS. 11F and 11G, respectively).
Figure 11B:
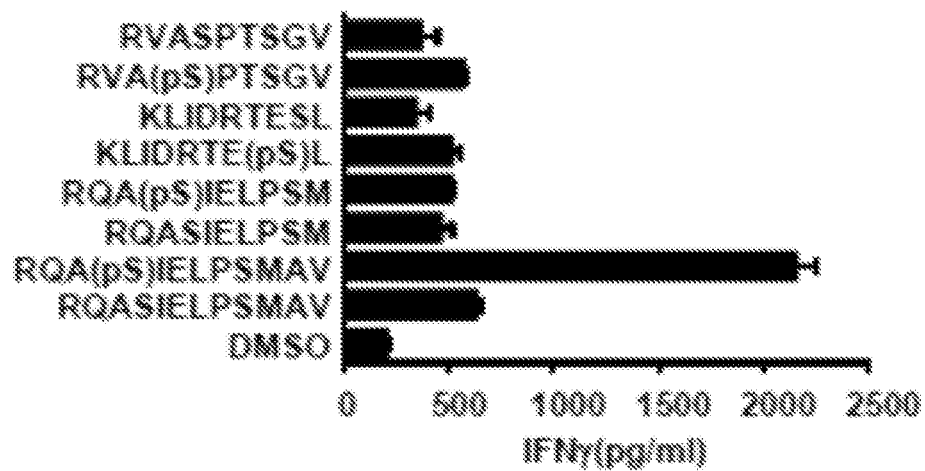

Three of the HLA-A2 and two HLA-B7 phosphopeptides were derived from LSP-1, a protein previously identified as a potential tumor marker. One of these, RQA(pS)IELPSMAV (SEQ ID NO: 452), was selected for initial immunological studies due to its widespread expression on all HLA-A2⁺ tumor samples analyzed and also because it was present on tumor samples at high copy number. Monocyte-derived dendritic cells were generated from healthy donors and used to prime autologous T cells and HLA-phosphopeptide tetramers were used to enrich phosphopeptide-specific T cells, between each stimulation steps, to produce a monospecific T cell line (see FIG. 11A). RQA(pS)IELPSMAV (SEQ ID NO: 452)-specific T cells produced IFNγ in response to RQA(pS)IELPSMAV (SEQ ID NO: 452) phosphopeptide but not to the unphosphorylated RQASIELPSMAV (SEQ ID NO: 452) nor to closely related phosphopeptides such as RQA(pS)IELPSM (SEQ ID NO: 248) and was also identified on all HLA-A2⁺ primary tumor cells (see FIG. 11B). Recognition was, therefore, phosphate-dependent and phosphopeptide-specific.

Figure 11C:
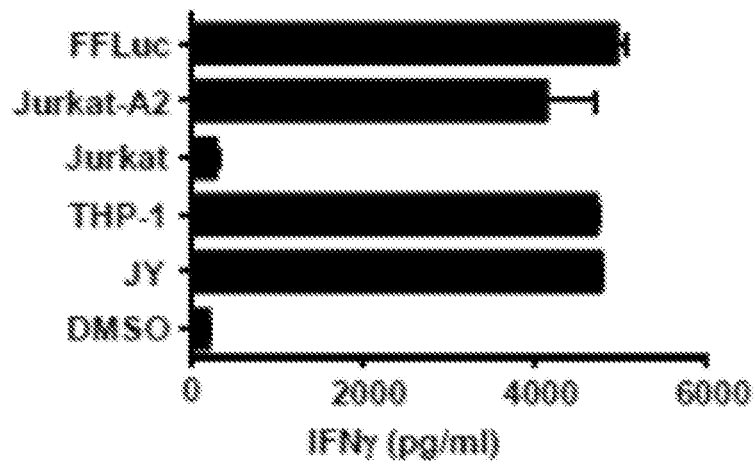
Figure 11D:
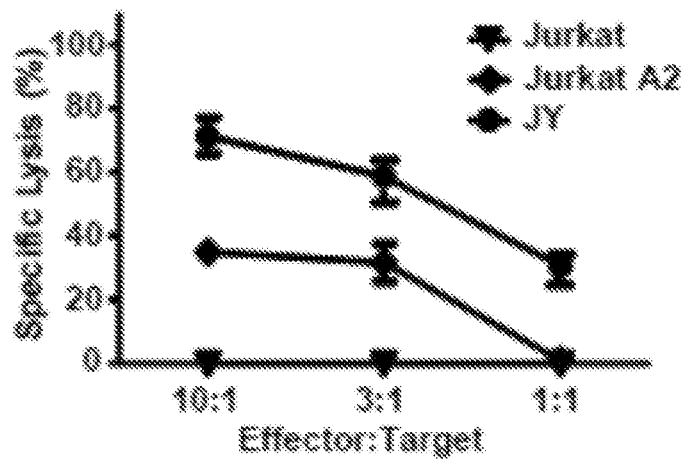
Figure 11E:
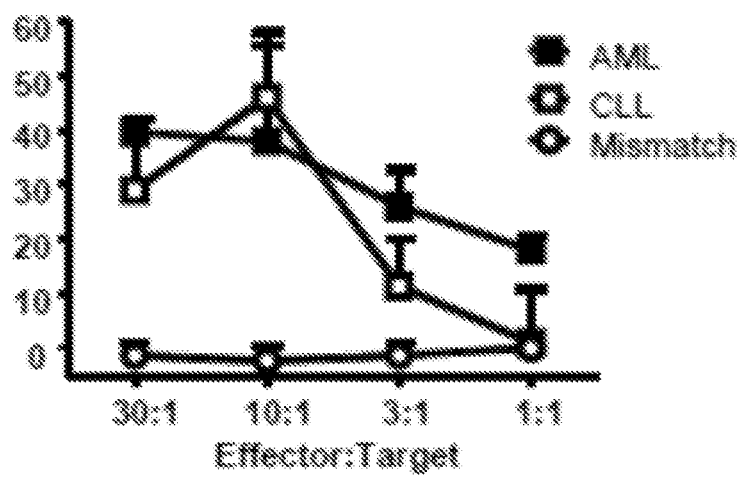
Figure 11F:
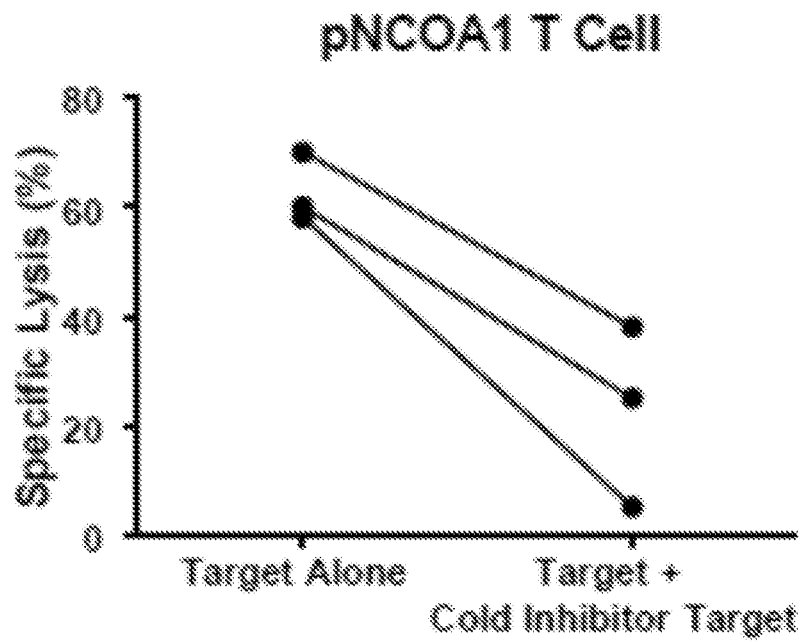
Figure 11G:
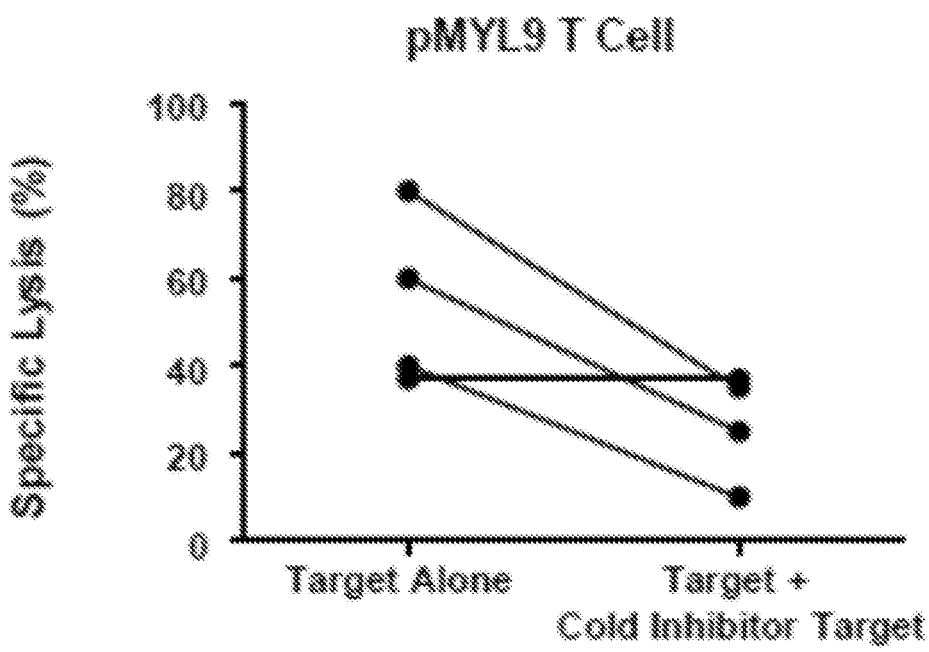

Furthermore, these in vitro expanded T cell lines were able to recognize and kill tumor cell lines (see FIGS. 11C and 11D), and the HLA-A2-transfected ALL cell line Jurkat-A2, but not the native Jurkat cell line confirming HLA-A2 restriction. Notably, anti-RQA(pS)IELPSMAV (SEQ ID NO: 452)-specific T cells were able to kill primary AML and CLL tumors (see FIG. 11E). Similarly HLA-B7-restricted anti-NCOA1 and MYL9-specific T cells grown from healthy donors showed remarkable killing towards three different primary CLL tumor cells (see FIGS. 11F and 11G).

Surprisingly, anti-phosphopeptide responses could be readily elicited in healthy individuals using dendritic cells. Immunity against 76 HLA-B7 and 10 HLA-A2 leukemia-associated phosphopeptide antigens was assessed in 10 HLA-A2⁺ and 10 HLA-B7⁺ healthy individuals (see FIG. 12A). Immune responses were observed for 50/76 (66%) HLA-B7 and 9/10 (90%) HLA-A2 antigens, with an average of 16/76 (21%) responses for HLA-B7 and 2/10 (20%) for HLA-A2 detectable in each donor (range 11-22/76, 0-4/10).

No immunity was observed for several phosphopeptides encoded by some leukemia oncogenes, most notably MYC, BCL-11A, and EP300; perhaps as both MYC and BCL-11A phosphopeptides were also observed on normal T cells. However, phosphopeptides from other leading leukemia oncogenes, such as MLL, GFI, and MEF2D elicited some of the strongest immune responses. Of note, phosphopeptides derived from a single phosphoprotein could elicit differential responses. For example, LSP-1 derived peptides RQA(pS)IELPSMAV (SEQ ID NO: 452) and QPR(pT)PSPLVL (SEQ ID NO: 304) were associated with some of the strongest responses whereas RQA(pS)IELPSM (SEQ ID NO: 451) and KLIDRTE(pS)L (SEQ ID NO: 440) were not immunogenic despite the tumor-specific expression of KLIDRTE (pS)L (SEQ ID NO: 440). These data suggested that both antigen-expression and phosphorylation site can determine immunogenicity.

For the most immunodominant responses, T cell specificity was confirmed using HLA-phosphopeptide multimers (see FIG. 12B) that suggested that these T cells expressed moderate or high affinity T cell receptors. Furthermore, no responses were observed for the unphosphorylated counterpart peptides (see FIG. 12C), confirming these responses were phosphoantigen-specific.

In order to assess the relative magnitude of these responses in peripheral blood, the immunity against some of the most immunodominant anti-phosphoantigen with immunodominant viral epitopes was compared. Previously characterized HLA-B7-restricted immunodominant epitopes from three persistent viruses (CMV, EBV, and HSV) and two non-persistent viruses (influenza and adenovirus) were selected. Immunity against four phosphopeptide antigens was similar to, or above, that of both non-persistent viruses, yet, with the exception of HSV, below the level of the persistent viruses in all donors tested (see FIG. 12D).

Example 33

Leukemia-Associated Phosphoantigen-Specific Immunity Resides within the Memory Compartment of Healthy Donors and Exhibits Cytotoxic Activity Owing to the fact that experiments thus far had relied upon 7-day recall responses, it was possible that these responses reflected ex vivo priming of naïve T cells. An experiment was performed to investigate whether the phosphopeptide immunity resided within the memory or naïve circulating T cell compartment. CD8$^+$ T cells were flow-sorted from peripheral blood into naïve ($T_N$), central memory ($T_{CM}$), effector memory ($T_{EM}$), and terminal effector memory cells ($T_{EMRA}$) according to the expression of CD45RA and CD27. The level of anti-phosphopeptide immunity was then determined using ELISpot in three HLA-B7$^+$ healthy donors (see FIG. 12E and FIG. 15).

Surprisingly, these data demonstrated that anti-phosphopeptide T cell immunity resides within the memory T cell compartment (see FIG. 12E), and these T cells are of predominant $T_{CM}$ phenotype. Moreover, these data suggested that the majority of healthy individuals had primed immunity against tumor-associated phosphoantigens.

Example 34

Phosphoantigen-Specific Immunity is Absent in the Majority of Patients with Leukemia The level of leukemia-specific phosphoantigen-directed CD8$^+$ T cell immunity in patients with leukemia was determined. Immunocompetent patients with early-stage CLL or patients in complete remission with AML were selected.

As tumor cells are present at high levels within isolated PBMCs from CLL patients, comparative analysis of data generated from patients and healthy individuals is difficult. Therefore, purified CD8$^+$ T cells isolated from 10 HLA-B7$^+$ healthy individuals and 14 HLA-B7$^+$ CLL patients (see Table 23) were used and assessed for immunity against CLL-associated phosphopeptides using overnight IFNγ ELISpot analysis (see FIGS. 16 and 17). As before, immune responses to most of these phosphopeptides in all healthy HLA-B7$^+$ individuals were detected, however, only a subset of CLL patients had evidence of a similar level of immunity (see FIG. 13A).

The CLL patients could be categorized into two distinct groups: Group 1 (9/14; 64%) had low or absent immunity to all CLL-associated phosphoantigens (<5 SFC/2×10$^5$ CD8$^+$ T cells), and Group 2 (5/14; 36%) demonstrated levels of immunity similar to that of the healthy donors. Comparing the sum of the immunity against all 14 phosphopeptide antigens between these groups (see FIG. 13B) revealed lower total immunity in both groups with a large difference between Group 1 and healthy donors (p<0.0001; t-test) but the same analysis did not reach significance for Group 2 (p=0.08; t-test). Curiously, these data also revealed a bimodal distribution of immunity within healthy individuals (see FIG. 13B).

Figures 13A, 13B:
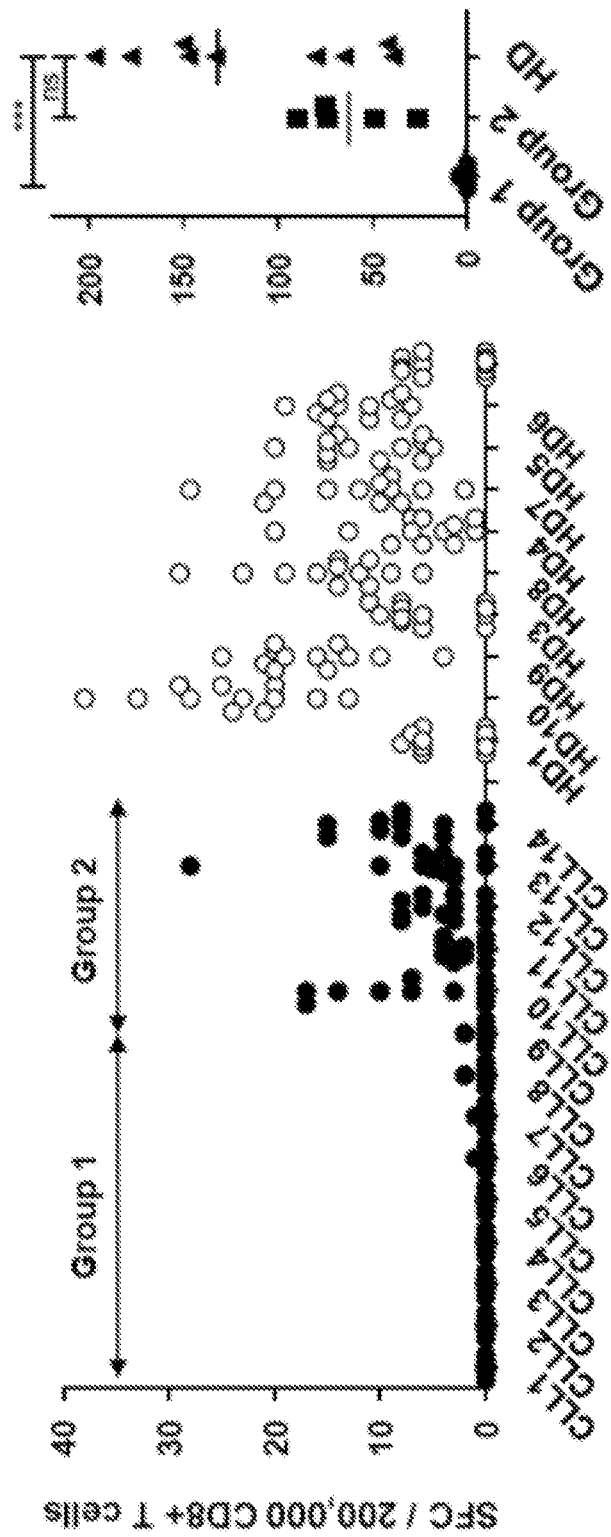
Figure 13C:
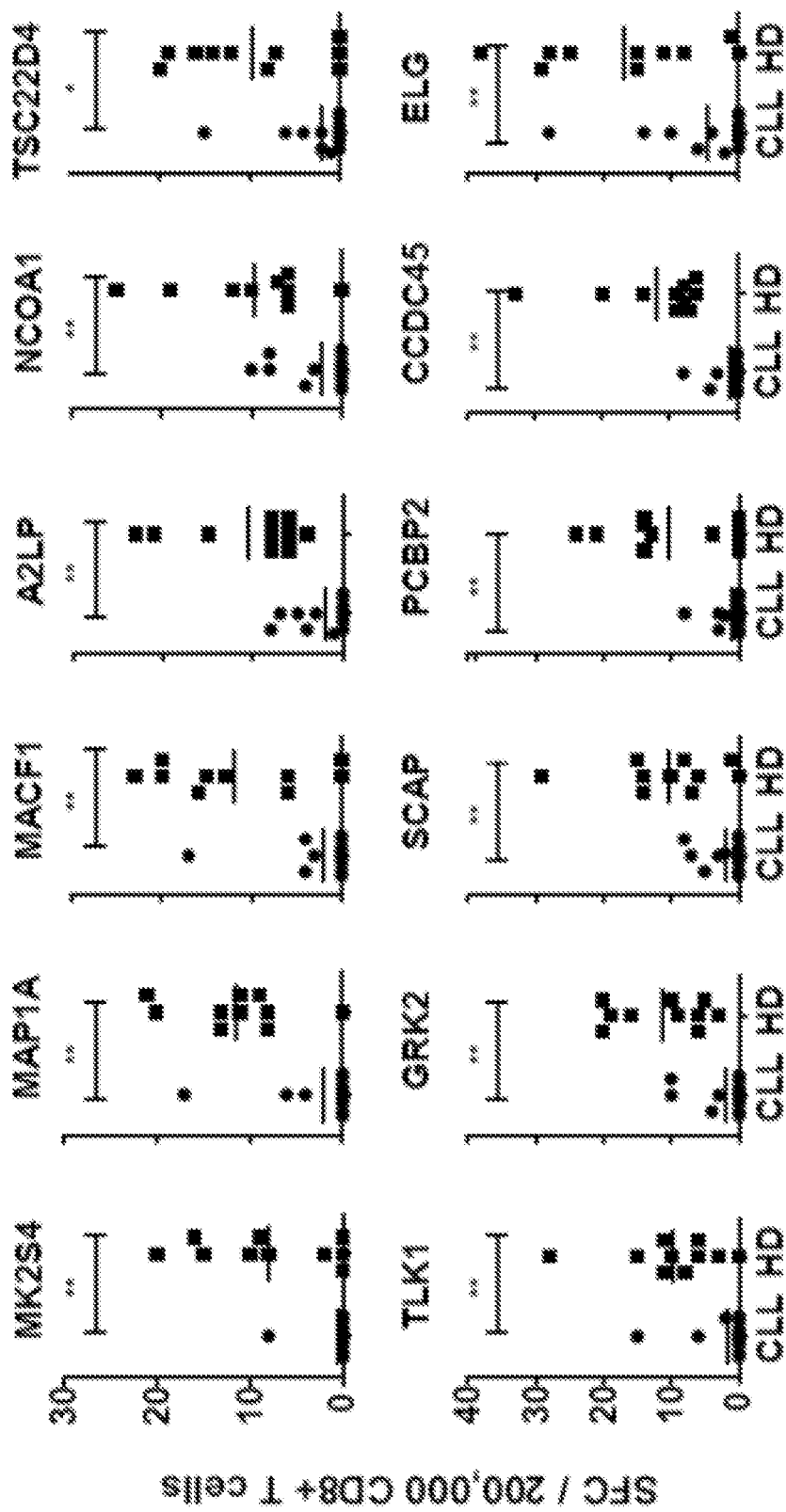
Figures 13D, 13E, 13F:
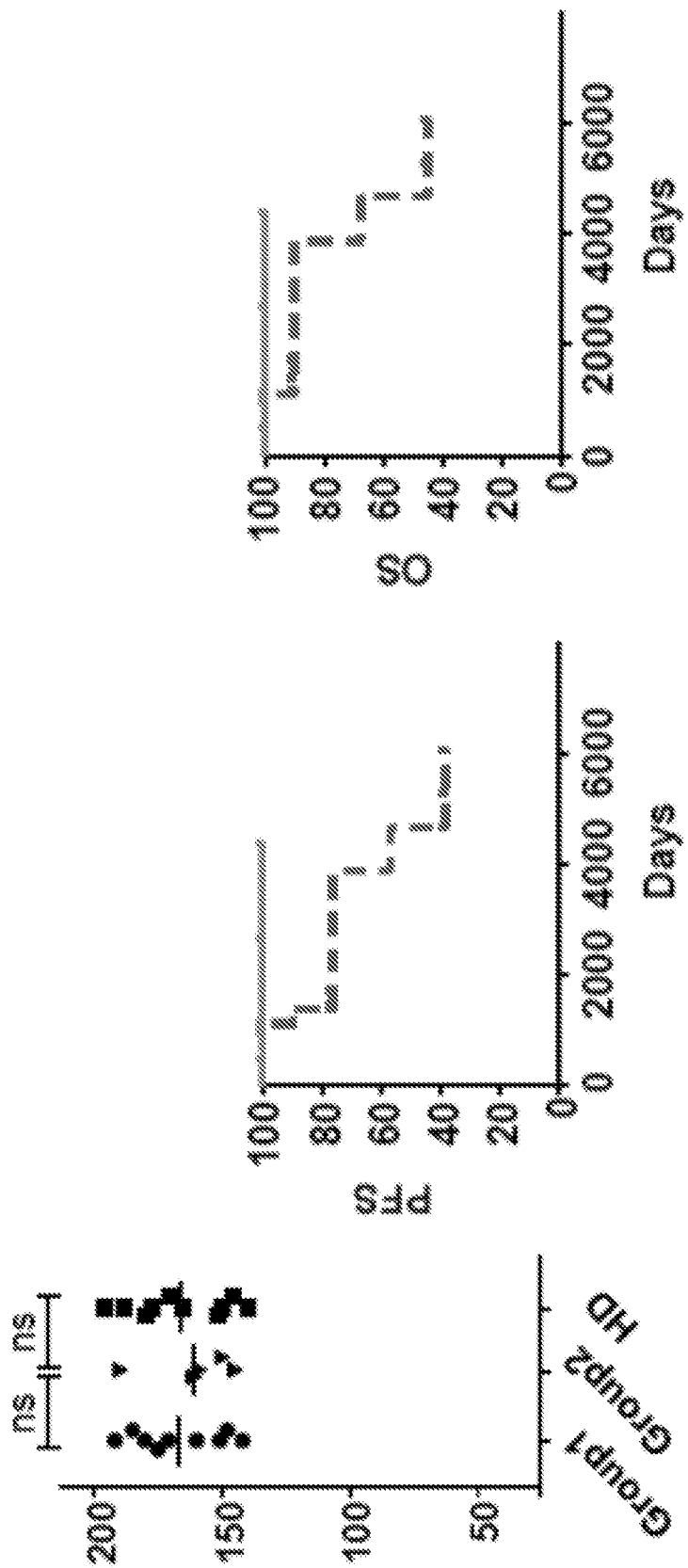
Figure 13G:
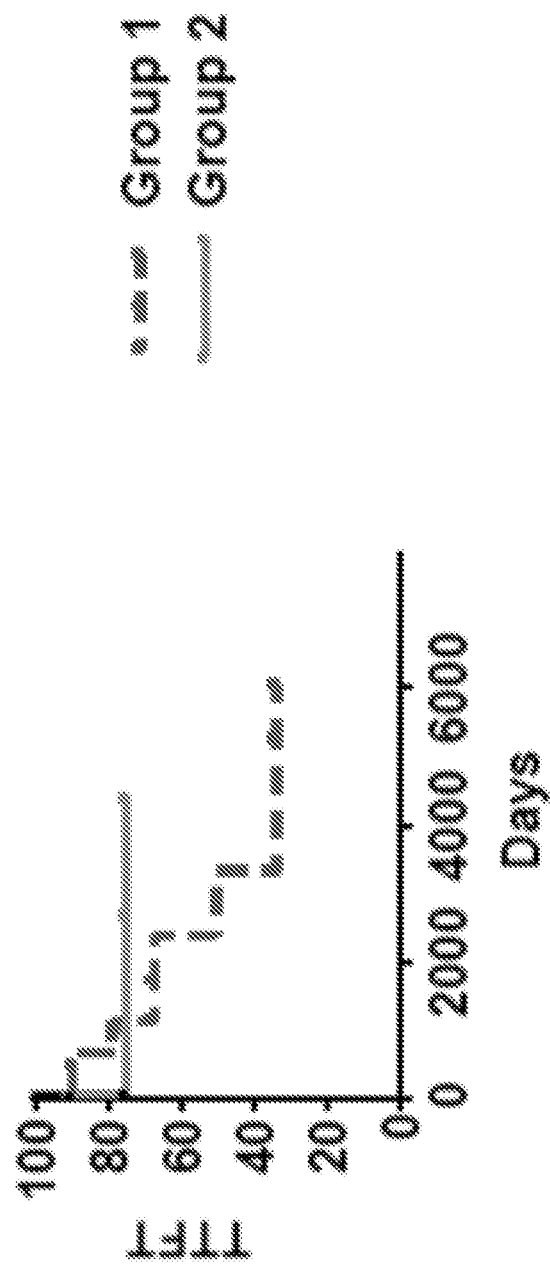

Individual analyses of responses to each epitope revealed magnitude of all responses were significantly different between patients and healthy individuals (see FIG. 13C). To test whether this lack of CD8$^+$ phosphoantigen-specific immunity in patients was due to a global depression of T cell immunity responses, bulk CD8$^+$ T cell responses to low level anti-CD3 stimulation was assessed; data that argue against any global T cell immune paresis in either CLL group (see FIG. 13D).

In order to assess whether the absent anti-phosphoantigen immunity in Group 1 CLL patients reflected T cell anergy, the experiments for a subset of phosphopeptide antigens in the presence of IL-2 were repeated. Positive controls to anti-CD3 stimuli increased in the presence of IL-2, as expected, but no anti-phosphopeptide immunity was detected. This suggested that T cells in this group of patients had been deleted rather than being in a state of anergy (see FIGS. 16 and 17).

Because CLL is a heterogeneous disease where, in many cases, the disease behaves in an indolent manner, whilst for others the disease is aggressive, whether the level of phospho-directed immunity predicted patient outcome was evaluated. Progression-free survival (PFS), overall survival (OS), and time to first treatment (TTFT) were analyzed between Group 1 and Group 2 (see FIGS. 13E-13G). Despite selecting early stage disease, there were large differences in PFS, OS, and TTFT between the groups, with patients exhibiting anti-phosphoantigen immunity (Group 2) surviving longer and requiring less treatment than those lacking such immunity.

To develop a more complete understanding of phosphoantigen-directed T cell immunity in patients with leukemia, these studies were extended into AML using a panel of 14 AML-specific phosphopeptide antigens. A cohort of 12 patients in complete remission (CR) with AML (see Table 24) were assessed using 7-day recall responses, as measured by ELISpot, and compared against a cohort of 12 healthy donors (see FIGS. 14A and 16).

Immune responses to most of these phosphopeptides in all (12/12) healthy HLA-B7 individuals were detected. Interestingly, as with patients with CLL, patients with AML could also be grouped into two groups: Group 1 (10/12) demonstrated limited phosphor-specific immunity, and a smaller Group 2 (2/10) demonstrated normal levels of immunity (see FIG. 14A). The total immune responses across all 14 phosphopeptide antigens was significantly greater in healthy donors than patients (see FIG. 14B; p<0.0001), in addition to the majority of phosphoantigens analyzed on an individual basis (see FIG. 14C).

Immunity against non-specific stimuli (anti-CD3) was similar between the groups, showing that the lack of antiphosphopeptide responses in patients was not due to immunosuppressant status (see FIG. 17). In keeping with this absolute lymphocyte counts for all 12 patients with AML were within the normal range (see Table 24).

Example 35

Phosphoantigen-Specific Immunity is Restored Following Stem Cell Transplantation (SCT)

It is known that immune reconstitution following SCT correlates with outcome, yet the antigens targeted by the transplanted immune responses are only partly understood. Since all healthy individuals assessed herein had immunity against leukemia-associated phosphoantigens and further that some patients with AML have reduced or absent immunity against these antigens, it was hypothesized that SCT might reconstitute this potentially protective absent immunity.

To test this hypothesis, all 12 AML patients underwent allogeneic SCT and immune reconstitution against 14 AML-specific phosphopeptide antigens was monitored. Immunity was at least partly restored in the majority of patients studied (see FIGS. 14C-14F). For some patients, immune reconstitution was studied in more detail. For patient AML8 marked expansions of 6 different phosphopeptide immune responses were observed (see FIG. 14E).

Figure 14F:
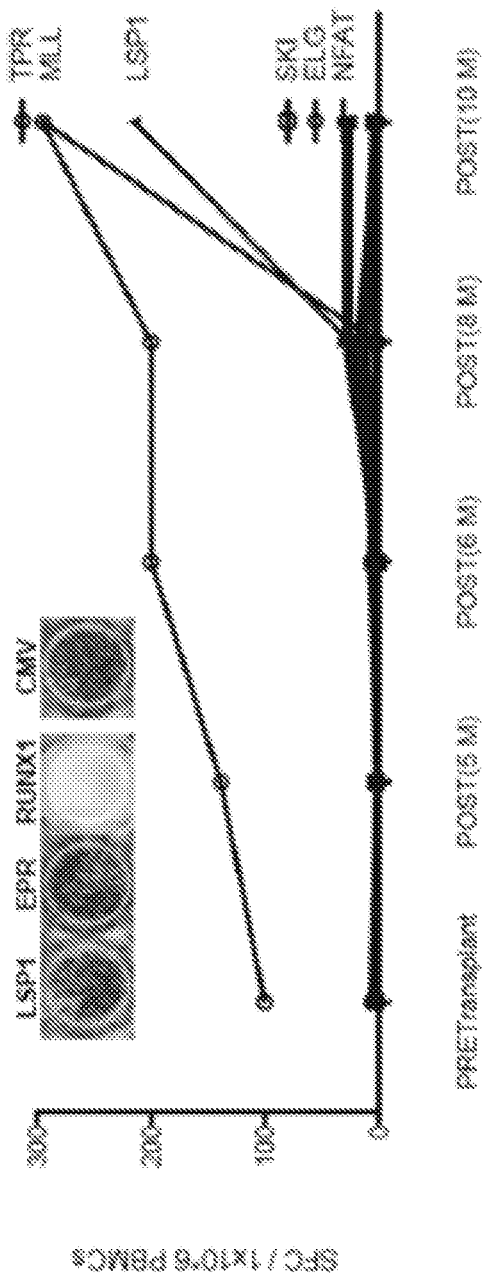
Figure 14G:
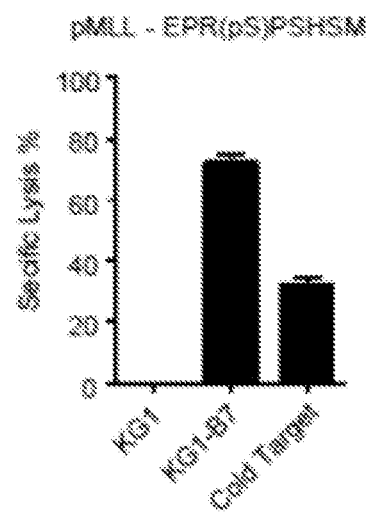

For patient AML4 dramatic expansion was observed for certain phosphopeptide antigens MLL (EPR) and LSP1 (QPR; see FIG. 14F). These responses were as large as those against immunodominant CMV-specific responses (pp65, TPR). Furthermore, in vitro expanded patient derived MLL-specific T cells were able to kill AML cells (see FIG. 14G) confirming the functional relevance of these cells.

Example 36

Tumor Samples

All cell lines were grown at 37° C. with 5% $CO_2$ in growth medium consisting of RPMI 1640 supplemented with 10% FCS and two mM L-glutamine. Blood or leukapheresis samples were taken from patients with high-burden leukemia in heparin. Tumor cells were recovered by layering the blood over density gradient (Ficoll) and collecting the tumor layer following centrifugation. The tumor was washed in tris-buffered saline (TBS). The purity of the tumor was assessed using flow cytometry and was >98% pure in all cases. For healthy T and B-cell populations, a normal spleen sample processed and tonsil sample was collected and lymphocytes released through mechanical disruption. Mononuclear cells were isolated using a density gradient and $10^9$ T cells isolated using anti-CD19 or anti-CD3 microbeads (Miltenyi Biotec Inc., Auburn, Calif., United States of America) with purity >98% were obtained. Bone marrow sample was obtained from an elective orthopedic procedure and red cell-depleted using hypotonic lysis. This sample was not processed further.

Example 37

Isolation of HLA-Associated Peptides

Class I MHC molecules were immunoaffinity purified from the JY cell line or from primary tumor samples, and their associated peptides were extracted as previously described in Zarling et al., 2006. Approximately 1.2-14×$10^9$ cells were lysed in a solution containing 20 mM Tris-HCl (pH 8.0), 150 mM NaCl, 1% CHAPS, one mM PMSF, five µg/mL aprotinin, 10 µg/mL leupeptin, 10 µg/mL pepstatin A, 1 µg/ml calyculin A, and phosphatase inhibitor (cocktails I and II; Sigma-Aldrich). The mixture was subjected to centrifugation and the resulting supernatant was passed over protein A sepharose pre-loaded with the HLA-A2-specific antibody BB7.2 or HLA-B7-specific antibody ME1. Peptides were eluted from the purified class I MHC molecules with 10% acetic acid.

Example 38

Cytotoxicity Assays

The cytotoxic specificity was determined with a standard 4 hour Cr release assay as previously described in Cobbold et al., 2005.

Example 39

T Cell Recognition Assays

For ELISpot analysis, PBMCs and $CD8^+$ T cells were isolated fresh from healthy donors and patients. 1×$10^6$ PBMCs were isolated from both AML patients and healthy donors and resuspended in AIM-V media (10% human AB serum) in a 96 well plate. Peptide or phosphopeptides were added individually at 10 µg/ml and placed at 37° C. in $CO_2$ incubator for 7 days. Cells were then harvested, washed 4 times, and re-challenged with phosphopeptides, peptides, or anti-CD3 (OKT3, 100 ng/ml, Mabtech, Inc., Mariemont, Ohio, United States of America) as per the manufacturer's instructions. Individual cytokine-producing cells were identified as dark spots after a 15 minute reaction with 5-bromo-4-chloro-3-indolyl phosphate and NBT by means of an alkaline phosphatase conjugate substrate (Mabtech). Spots were counted using an automated reader (AID Diagnostika GmbH, Straßberg, Germany), and results displayed as number of spot-forming cells (SFC) per $10^6$ PBMCs.

For CLL patients a different approach had to be taken as $10^6$ PBMCs from peripheral blood resulted in 99% enrichment of B-cells. Therefore $CD8^+$ T cells were magnetically enriched using anti-CD8 microbeads (Miltenyi Biotec) to a purity of >99% for both healthy donors and patients with CLL. 200,000 $CD8^+$ T cells from both patients and healthy donors were used for ELISpot analysis as described above.

Example 40

Generation of Human Phosphopeptide-Specific $CD8^+$ Cytotoxic T Cells

HLA-A2 restricted RQA-V (SEQ ID NO: 2375) phosphopeptide-specific cytotoxic $CD8^+$ T cells were generated from healthy donors as described previously in Ho et al., 2006. Briefly, PBMCs were cultured in flat-bottom 6-well plates at $10^7$ cells per well in RPMI 1640 plus 10% heat-inactivated human AB serum (10% media). GM-CSF (800 IU/mL), and IL-4 (1000 units/mL; PeproTech) were added on day 0 to generate dendritic cells (DC). On day 1, a maturation cocktail was added containing 100 ng/ml TNFα, 100 ng/ml IL-1β, 10,000 IU/ml IL-6, 8,000 IU/ml GM-CSF, and 10 µg/ml $PGE_2$. On day 2, DCs were harvested and loaded with phosphopeptide (20 µg/ml) and T cells added at a ratio of five T cells per DC. Recombinant IL-7 (10 ng/ml) and IL-15 (10 ng/ml) were added on day 5. On day 9, T cells were harvested and re-stimulated by adding 10$^7$ irradiated PBMCs and 10$^6$ irradiated autologous LCLs pulsed with peptide with IL-7 (5 ng/ml), IL-15 (5 ng/ml), and IL-2 (20 IU/ml), and re-stimulated every 7 days in the same manner thereafter. At each re-stimulation, T cells were enriched using either anti-CD8 microbeads (Miltenyi Biotec) or by labeling with HLA-phosphopeptide tetramers and using anti-PE microbeads (Miltenyi Biotec). HLA-B7-restricted anti-phosphopeptide T cells were grown in the absence of dendritic cells by plating 5×10$^6$ PBMCs in 48 well plates in 10% media with individual phosphopeptides at 10 µg/ml for 7-10 days without cytokines. Re-stimulations with irradiated peptide-pulsed autologous PBMCs and cytokines took place thereafter once or twice and cytotoxicity assays performed as previously described.

Example 41

Peptides

The peptides disclosed in the EXAMPLES were synthesized with Fmoc chemistry, isolated by HPLC to >90% purity, and validated with mass spectrometry (EZ-Biolabs, Carmel, Ind., United States of America and Genscript, Piscataway, N.J., United States of America).

Example 42

HLA-Phosphopeptide Tetramers

HLA tetramers were synthesized by the use of standard methods, and the components of the HLA-peptide tetramers that were used in the study are shown in Table 3.

Example 43

Memory T Cell Response

Quantification of T cell IFNγ production in response to peptides was performed by ELISPot as per manufacturer's instructions. In brief, ELISpotPRO wells pre-coated with IFNγ monoclonal antibody mAb 1-D1K (MabTech, product code: 3420-2APW-2) were washed four times with sterile PBS and blocked for 30 minutes with 200 µl 10% RPMI 1640 after which the blocking medium was removed.

1×10$^6$ PBMCs were added to each well and peptide was added directly at a concentration of 10 µg/ml. Plates were cultured at 37° C. for 24 hours after which wells were emptied and washed five times with 200 µl sterile PBS. The alkaline phosphatase (ALP)-labelled one step detection reagent 7-B6-1-ALP (MabTech) was diluted 1:200 in PBS with 0.05% FBS. 100 µl was added and incubated at room temperature for two hours. Wells were then emptied and washed five times with 200 µl sterile PBS. 100 µl filtered BCIP/NBT substrate was added to each well and incubated for 15 minutes at room temperature. To stop the reaction, plates were washed under running water and then dried by exposure to air. Spots were counted using an ELISpot reader.

Table 8 ummarizes the results of a Day 7 ELISpot experiment that demonstrated that healthy humans had an immunological recall response to certain the leukemia class I phosphopeptides. Importantly, this response came from central memory T cells and was comparable to the recall response that the same individuals had to viral peptides presented as a result of flu, EBV, etc.

TABLE 8

Day 7 ELISpot Results

| | SFU/500, 000 PBMC | | | | | |
|---|---|---|---|---|---|---|
| | GS | AH | AE | GR | PM | MH |
| APR | | | | + | ++ | |
| IMD | | | | | +++ | + |
| RTF | + | | | | | + |
| YLD | | | | + | | + |
| VMI | | ++ | | + | ++ | ++ |
| GLL | | | | | + | + |
| RVA | | | | | ++ | ++ |
| RVAk | | | | | | |
| NLV (CMV) | + | ++ | + | | | + |
| TPR (CMV) | | | | | +++ | + |
| GLC (EBV) | + | | | ++ | +++ | +++ |
| RPP (EBV) | + | + | ++ | | | + |
| FLU | ++ | | +++ | | | |
| ADENO | | | +++ | | | |

+: 3-24 spots; ++: 25-99 spots; +++: >100 spots

With respect to Table 8, the left column lists various synthetic samples of melanoma class I A*00201 phosphopeptides including those from IRS2, b-catenin, CDC25B, BCAR3, Tensin 3, and Synemin. They were tested on six healthy A2 positive donors and memory T cell response for several of the peptides were observed. "APR" is APRRYsSSL (SEQ ID NO: 267); "IMD" is IMDRtPEKL (SEQ ID NO: 398); "RTF" is RTFsPTYGL (SEQ ID NO: 416); "YLD" is YLDsGIHSGV (SEQ ID NO: 2080); "VMI" is VMIGsPKKV (SEQ ID NO: 2232); "GLL" is GLLGsPVRA (SEQ ID NO: 396); "RVA" is RVAsPTSGV (SEQ ID NO: 418); "RVAk" is RVAsPTSGVK (SEQ ID NO: 65); "NLV" and "TPR" are cytomegalovirus (CMV) peptides, "GLC" and "RPP" are Epstein-Barr Virus (EBV) peptides; and "FLU" and "ADENO" are influenza and adenoviral peptides, respectively. Phosphopeptide sequences; pSer, pThr and pTyr are specified by s, t, and y, respectively.

APR (APRRYsSSL; SEQ ID NO: 267) is a B*0702 binding peptide that does not bind to A*0201 and was used as the control for the other peptides. Two healthy donors (HD) responded to APR because they are both A*0201 and B*0702 positive. RVA (RVAsPTSGV; SEQ ID NO: 418) comes from IRS2 and binds to A*0301 so it did not bind to A*0201 and was employed as a control. None of the HD recognized or responded to it.

REFERENCES

All references listed in the instant disclosure, including but not limited to all patents, patent applications and publications thereof, scientific journal articles, and database entries (including but not limited to GENBANK® database entries and including all annotations available therein) are incorporated herein by reference in their entireties to the extent that they supplement, explain, provide a background for, and/or teach methodology, techniques, and/or compositions employed herein. The discussion of the references is intended merely to summarize the assertions made by their authors. No admission is made that any reference (or a portion of any reference) is relevant prior art. Applicants reserve the right to challenge the accuracy and pertinence of any cited reference.

REFERENCES

Akamatsu et al. (1997) *Bioorg & Med Chem* 5:157-163.
Altman et al. (1996) Phenotypic analysis of antigen-specific T lymphocytes. *Science* 274:94-96 [published erratum appears in *Science* 1998 Jun. 19; 280(5371):1821].
Arentz-Hansen et al. (2000) The intestinal T cell response to alpha-gliadin in adult celiac disease is focused on a single deamidated glutamine targeted by tissue transglutaminase. *J Exp Med* 191:603-612.
Arozarena et al. (2011) In melanoma, beta-catenin is a suppressor of invasion. *Oncogene* 30(45):4531-4543.
Bachmann et al. (2005) Importance of P-cadherin, beta-catenin, and Wnt5a/frizzled for progression of melanocytic tumors and prognosis in cutaneous melanoma. *Clin Cancer Res* 11:8606-8614.
Baron et al. (2005) Graft-versus-tumor effects after allogeneic hematopoietic cell transplantation with nonmyeloablative conditioning. *J Clin Oncol* 23:1993-2003.
Bertoletti et al. (1994) Natural variants of cytotoxic epitopes are T cell receptor antagonists for antiviral cytotoxic T cells. *Nature* 369:407-410.
Berzofsky et al. (1988) Antigen processing for presentation to T lymphocytes: function, mechanisms, and implications for the T cell repertoire. *Immunol Rev* 106:5-31.
Boon et al. (1994) *Annu Rev Immunol* 12:337-365.
Brahmer et al. (2012) *N Engl J Med* 366:2455-2465.
Bullock et al. (2000) The density of peptides displayed by dendritic cells affects immune responses to human tyrosinase and gp100 in HLA-A2 transgenic mice. *J Immunol* 164:2354-2361.
Carvajal et al. (2011) *J Am Med Assoc* 305:2327-2334.
Chi (2011) Cancer research: Promise of protection. *Nature* 471:537-538.
Chien et al. (2009) Activated Wnt/beta-catenin signaling in melanoma is associated with decreased proliferation in patient tumors and a murine melanoma model. *Proc Natl Acad Sci USA* 106:1193-1198.
Chothia et al. (1989) *Nature* 342:877-883.
Clackson et al. (1991) *Nature* 352: 624-628.
Clark et al. (1989) *Eur J Immunol* 19:381-388.
Clothia et al. (1985) *J Mol Biol* 186:651-666.
Cobbold et al. (2005) Adoptive transfer of cytomegalovirus-specific CTL to stem cell transplant patients after selection by HLA-peptide tetramers. *J Exp Med* 202:379-386.
Cole et al. (1985) *Proc Natl Acad Sci USA* 82:859.
Cote et al. (1983) *Proc Natl Acad Sci USA* 80:2026.
Crawford et al. (1999) The metalloproteinase matrilysin is a target of beta-catenin transactivation in intestinal tumors. *Oncogene* 18:2883-2891.
Demunter et al. (2002) Loss of membranous expression of beta-catenin is associated with tumor progression in cutaneous melanoma and rarely caused by exon 3 mutations. *Modern Pathol* 15:454-461.
Dephoure et al. (2008) A quantitative atlas of mitotic phosphorylation. *Proc Natl Acad Sci USA* 105:10762-10767.
Depontieu et al. (2009) Identification of tumor-associated, MHC class II-restricted phosphopeptides as targets for immunotherapy. *Proc Natl Acad Sci USA* 106:12073-12078.
Dudley et al. (2008) Adoptive cell therapy for patients with metastatic melanoma: evaluation of intensive myeloablative chemoradiation preparative regimens. *J Clin Oncol* 26:5233-5239.
DuPage et al. (2012) Expression of tumour-specific antigens underlies cancer immunoediting. *Nature* 482:405-409.
Fecher & Flaherty (2009) *J Natl Compr Canc Netw* 7:295-304.
Finn (2003) Premalignant lesions as targets for cancer vaccines. *J Exp Med* 198:1623-1626.
Fiol et al. (1988) Phosphoserine as a recognition determinant for glycogen synthase kinase-3: phosphorylation of a synthetic peptide based on the G-component of protein phosphatase-1. *Arch Biochem Biophys* 267:797-802.
Fiol et al. (1990) Ordered multisite protein phosphorylation. Analysis of glycogen synthase kinase 3 action using model peptide substrates. *J Biol Chem* 265:6061-6065.
Fischbein et al. (2000) CD40 signaling replaces $CD4^+$ lymphocytes and its blocking prevents chronic rejection of heart transplants. *J Immunol* 165:7316-7322.
Fishwild et al. (1996) *Nature Biotechnol* 14:845.
Gale et al. (1994) Identical-twin bone marrow transplants for leukemia. *Ann Intern Med* 120:646-652.
Gattinoni et al. (2006) *Nat Rev Immunol* 6: 383-93.
GB 2249310A.
Gerdes et al. (1999) Analysis of beta-catenin gene mutations in pancreatic tumors. *Digestion* 60:544-548.
Girbal-Neuhauser et al. (1999) The epitopes targeted by the rheumatoid arthritis-associated antifilaggrin autoantibodies are posttranslationally generated on various sites of (pro)filaggrin by deimination of arginine residues. *J Immunol* 162:585-594.
Goldman & DeFrancesco (2009) The cancer vaccine roller coaster, *Nat Biotech* 27:129-139 (Corrected online: 7 Jun. 2010|doi:10.1038/nbt0209-129).
Hall et al. (2010) Comprehensive analysis of phosphorylation sites in Tensin1 reveals regulation by p38MAPK. *Mol Cellul Proteom* 9:2853-2863.
Haluska et al. (2006) Genetic alterations in signaling pathways in melanoma. *Clin Cancer Res* 12:2301s-2307s.
Hamann et al. (1997) Phenotypic and functional separation of memory and effector human $CD8^+$ T cells. *J Exp Med* 186:1407-1418.
Harlow & Lane (1988) *Antibodies: A Laboratory Manual*, Cold Spring Harbor Laboratory Press, Cold Spring Harbor, N.Y., United States of America).
He et al. (1998) Identification of c-MYC as a target of the APC pathway. *Science* 281:1509-1512.
Hirohashi et al. (2009) The functioning antigens: beyond just as the immunological targets. *Cancer Sci* 100:798-806.
Ho et al. (2006) In vitro methods for generating $CD8^+$ T cell clones for immunotherapy from the naive repertoire. *J Immunol Meth* 310:40-52.
Hoek et al. (2006) Metastatic potential of melanomas defined by specific gene expression profiles with no BRAF signature. *Pigment Cell Res* 19:290-302.
Hogan et al. (1998) The peptide recognized by HLA-A68.2-restricted, squamous cell carcinoma of the lung-specific cytotoxic T lymphocytes is derived from a mutated elongation factor 2 gene. *Cancer Res* 58:5144-5150.
Homfray et al. (1998) Defects in mismatch repair occur after APC mutations in the pathogenesis of sporadic colorectal tumours. *Human Mutation* 11:114-120.
Hoogenboom et al. (1991) *Nucleic Acids Res* 19:4133.
Horowitz et al. (1990) Graft-versus-leukemia reactions after bone marrow transplantation. *Blood* 75:555-562.
Hulsken et al. (1994) E-cadherin and APC compete for the interaction with beta-catenin and the cytoskeleton. *J Cell Biol* 127:2061-2069.
Ilyas et al. (1997) Beta-catenin mutations in cell lines established from human colorectal cancers. *Proc Natl Acad Sci USA* 94:10330-10334.

Isakoff et al. (2005) Breast cancer-associated PIK3CA mutations are oncogenic in mammary epithelial cells. *Cancer Res* 65:10992-11000.

Jacob et al. (1997) *Int J Cancer* 71:325-332.

Jimbow et al. (1975) Mitotic activity in non-neoplastic melanocytes in vivo as determined by histochemical, autoradiographic, and electron microscope studies. *J Cell Biol* 66:663-670.

Jones et al. (2008) Core signaling pathways in human pancreatic cancers revealed by global genomic analyses. *Science* 321:1801-1806.

Jones et al. (1986) *Nature* 321:522-525.

Kabat et al., (1991) *Sequences of Proteins of Immunological Interest, Fifth Edition*, NIH Publication No. 91-3242, National Institute of Health, Bethesda, Md., United States of America.

Kageshita et al. (2001) Loss of beta-catenin expression associated with disease progression in malignant melanoma. *Br J Dermatol* 145:210-216.

Kantoff et al. (2010) Sipuleucel-T immunotherapy for castration-resistant prostate cancer. *N Engl J Med* 363:411-422.

Kielhorn et al. (2003) Tissue microarray-based analysis shows phospho-beta-catenin expression in malignant melanoma is associated with poor outcome. *Int J Cancer* 103:652-656.

Kim et al. (2000) beta-catenin expression and mutational analysis in renal cell carcinomas. *Pathol Intl* 50:725-730.

Kimelman & Xu (2006) beta-catenin destruction complex: insights and questions from a structural perspective. *Oncogene* 25:7482-7491.

Klenerman et al. (1994) Cytotoxic T cell activity antagonized by naturally occurring HIV-1 Gag variants. *Nature* 369:403-407.

Kohler & Milstein (1975) *Nature* 256:495.

Kolb (2008) Graft-versus-leukemia effects of transplantation and donor lymphocytes. *Blood* 112:4371-4383.

Kolb et al. (1990) Donor leukocyte transfusions for treatment of recurrent chronic myelogenous leukemia in marrow transplant patients. *Blood* 76:2462-2465.

Kozbor et al. (1983) *Hybridoma* 2:7.

Krengel et al. (2004) Cadherin expression pattern in melanocytic tumors more likely depends on the melanocyte environment than on tumor cell progression. *J Cutaneous Pathol* 31:1-7.

Kroger et al. (2005) Stem cell transplantation from identical twins in patients with myelodysplastic syndromes. *Bone Marrow Transplant* 35:37-43.

Ley et al. (2008) DNA sequencing of a cytogenetically normal acute myeloid leukaemia genome. *Nature* 456:66-72.

Liu et al. (2002) Control of beta-catenin phosphorylation/degradation by a dual-kinase mechanism. *Cell* 108:837-847.

Lonberg & Huszar (1995) *Int Rev Immunol* 13:65.

Lonberg et al. (1994) *Nature* 368:856.

Lucas & Coulie (2008) About human tumor antigens to be used in immunotherapy. *Seminars Immunol* 20:301-307.

Mackensen et al. (2000) *Int J Cancer* 86:385-392.

Maelandsmo et al. (2003) Reduced beta-catenin expression in the cytoplasm of advanced-stage superficial spreading malignant melanoma. *Clin Cancer Res* 9:3383-3388.

Mamula et al. (1999) Isoaspartyl post-translational modification triggers autoimmune responses to self-proteins. *J Biol Chem* 274:22321-22327.

Marafioti et al. (2004) Leukocyte-specific phosphoprotein-1 and PU.1: two useful markers for distinguishing T cell-rich B-cell lymphoma from lymphocyte-predominant Hodgkin's disease. *Haematologica* 89:957-964.

Marks et al. (1991) *J Mol Biol* 222:581-597.

Marks et al. (1992) *J Biol Chem* 267:16007.

Matsushita et al. (2012) Cancer exome analysis reveals a T cell-dependent mechanism of cancer immunoediting. *Nature* 482:400-404.

Melief (2009) *J Med Sci* 2:43-45.

Meyer et al. (2009) Identification of natural MHC class II presented phosphopeptides and tumor-derived MHC class I phospholigands. *J Proteome Res* 8:3666-3674.

Middleton et al. (2000) *J Clin Oncol* 18:158-166.

Mihara et al. (2001) *Clin Immunol* 98:319.

Miyake et al. (2001) Absence of mutations in the beta-catenin and adenomatous polyposis coli genes in papillary and follicular thyroid carcinomas. *Pathol Intl* 51:680-685.

Mohammed et al. (2008) Phosphorylation-dependent interaction between antigenic peptides and MHC class I: a molecular basis for the presentation of transformed self. *Nat Immunol* 9:1236-1243.

Molina et al. (2007) Global proteomic profiling of phosphopeptides using electron transfer dissociation tandem mass spectrometry. *Proc Natl Acad Sci USA* 104: 2199-2204.

Morales et al. (2000) *Nucl Med Biol* 27:199.

Morin et al. (1997) Activation of beta-catenin-Tcf signaling in colon cancer by mutations in beta-catenin or APC. *Science* 275:1787-1790.

Neuberger (1996) *Nat Biotechnol* 14:826.

Newberg et al. (1992) Species specificity in the interaction of CD8 with the α3 domain of MHC class I molecules. *J Immunol* 149:136-142.

Niedermann et al. (1995) Contribution of proteasome-mediated proteolysis to the hierarchy of epitopes presented by major histocompatibility complex class I molecules. *Immunity* 2:289-299.

Novotny & Haber (1985) *Proc Natl Acad Sci USA* 82:4592-4596.

Nunes et al. (2011) A novel tumor antigen derived from enhanced degradation of bax protein in human cancers. *Cancer Res* 71:5435-5444.

Offringa (2009) Antigen choice in adoptive T cell therapy of cancer. *Curr Opin Immunol* 21:190-199.

Ogasawara et al. (2006) Mutations and nuclear accumulation of beta-catenin correlate with intestinal phenotypic expression in human gastric cancer. *Histopathology* 49:612-621.

Ohgaki et al. (2004) APC mutations are infrequent but present in human lung cancer. *Cancer Lett* 207:197-203.

Oliva et al. (2006) High frequency of beta-catenin mutations in borderline endometrioid tumours of the ovary. *J Pathol* 208:708-713.

Olmeda et al. (2003) Beta-catenin regulation during the cell cycle: implications in G2/M and apoptosis. *Mol Biol Cell* 14:2844-2860.

Omholt et al. (2001) Cytoplasmic and nuclear accumulation of beta-catenin is rarely caused by CTNNB1 exon 3 mutations in cutaneous malignant melanoma. *Intl J Cancer* 92:839-842.

Otaka et al. (1995) *Tetrahedron Lett* 36:927-930.

Pardoll (2012) The blockade of immune checkpoints in cancer immunotherapy. *Nature Reviews Cancer* 12:252-264.

Parmiani et al. (2002) *J Natl Cancer Inst* 94:805-818.

Parsons et al. (2011) The Genetic Landscape of the Childhood Cancer Medulloblastoma. *Science* 331:435-439.

Pavletic et al. (2007) Genetically identical twin transplantation for chronic lymphocytic leukemia. *Leukemia* 21:2452-2455.

PCT International Patent Application Publication Nos. WO 1999/047929; WO 1994/02602; WO 1996/33735; WO 1996/34096; 2004/0202657; WO 2004/106380; 2009/0117102; WO 2011/149909.

Pecina-Slaus et al. (2007) E-cadherin and beta-catenin expression patterns in malignant melanoma assessed by image analysis. *J Cutaneous Pathol* 34:239-246.

Peiper et al. (1997) *Eur J Immunol* 27:1115-1123.

Peoples et al. (1993) *Surgery* 114:227-234.

Petersen et al. (2009) Phosphorylated self-peptides alter human leukocyte antigen class I-restricted antigen presentation and generate tumor-specific epitopes. *Proc Natl Acad Sci USA* 106:2776-2781.

Pollock & Hayward (2002) Mutations in exon 3 of the beta-catenin gene are rare in melanoma cell lines. *Melanoma Res* 12:183-186.

Presta (1992) *Proc Natl Acad Sci USA* 89:4285-4289.

Preudhomme et al. (2010) Imatinib plus peginterferon alfa-2a in chronic myeloid leukemia. *N Engl J Med* 363:2511-2521

Rappsilber et al. (2007) Protocol for micro-purification, enrichment, pre-fractionation and storage of peptides for proteomics using StageTips. *Nat Protocols* 2:1896-1906.

Restifo et al. (1993) Identification of human cancers deficient in antigen processing. *J Exper Med* 177:265-272.

Richards et al. (1999) *Cancer Res* 59:2096.

Riechmann et al. (1988) *Nature* 332:323-327.

Rimm et al. (1999) Frequent nuclear/cytoplasmic localization of beta-catenin without exon 3 mutations in malignant melanoma. *Am J Pathol* 154:325-329.

Robila et al. (2008) MHC class II presentation of gp100 epitopes in melanoma cells requires the function of conventional endosomes and is influenced by melanosomes. *J Immunol* 181:7843-7852.

Rock & Goldberg (1999) *Annu Rev Immunol* 17:739-779.

Rosenberg & Dudley (2009) Adoptive cell therapy for the treatment of patients with metastatic melanoma. *Curr Opin Immunol* 21:233-240.

Rosenberg et al. (1986) A new approach to the adoptive immunotherapy of cancer with tumor-infiltrating lymphocytes. *Science* 233:1318-1321.

Rosenberg et al. (2004) Cancer immunotherapy: moving beyond current vaccines. *Nat Med* 10:909-915.

Ruppert et al. (1993) Prominent role of secondary anchor residues in peptide binding to A2.1 molecules. *Cell* 74:929-937.

Sadot et al. (2002) Regulation of S33/S37 phosphorylated beta-catenin in normal and transformed cells. *J Cell Sci* 115:2771-2780.

Sandborn et al. (2001) *Gastroenterology*, 120:1330-1338.

Sanders et al. (1999) Alterations in cadherin and catenin expression during the biological progression of melanocytic tumours. *Mol Pathol* 52:151-157.

Schendel et al. (1993) *J Immunol* 151:4209-4220.

Schreiber et al. (2011) Cancer immunoediting: integrating immunity's roles in cancer suppression and promotion. *Science* 331:1565-1570.

Seidensticker & Behrens (2000) Biochemical interactions in the wnt pathway. *Biochim Biophys Acta* 1495:168-182.

Sette et al. (1994) The relationship between class I binding affinity and immunogenicity of potential cytotoxic T cell epitopes. *J Immunol* 153:5586-5592.

Shinkura et al. (1998) *Anticancer Res* 18:1217.

Slawson et al. (2005) Perturbations in O-linked β-N-acetylglucosamine proteim modification cause severe defects in mitotic progression and cytokinesis. *J Biol Chem,* 280: 32944-32956.

Slawson et al. (2008) A mitotic GlcN Acylation/phosphorylation signaling complex alters the posttranslational state of the cytoskeletal proteim vimentin. *Mol Biol Cell* 19:4130-4140.

Slingluff et al. (1994) *Cancer Res* 54:2731-2737.

Slingluff et al. (2000) Melanomas with concordant loss of multiple melanocytic differentiation proteins: immune escape that may be overcome by targeting unique or undefined antigens. *Cancer Immunol Immunother* 48:661-672.

Slovin et al. (1986) *J Immunol* 137:3042-3048.

Smyth et al. (1992) *Tetrahedron Lett* 33:4137-4140.

Strickley (2004) Solubilizing excipients in oral and injectable formulations. *Pharm Res* 21:201-230.

Sun et al. (2005) Infrequent mutation of APC, AXIN1, and GSK3B in human pituitary adenomas with abnormal accumulation of CTNNB 1. *J Neuro-Oncol* 73:131-134.

Takahashi et al. (2002) Identification of membrane-type matrix metalloproteinase-1 as a target of the beta-catenin/Tcf4 complex in human colorectal cancers. *Oncogene* 21:5861-5867.

Takemaru et al. (2008) An oncogenic hub: β-catenin as a molecular target for cancer therapeutics. *Handb Exp Pharmacol* 186:261-284.

Talpaz et al. (1986) Hematologic remission and cytogenetic improvement induced by recombinant human interferon alpha A in chronic myelogenous leukemia. *N Engl J Med* 314:1065-1069.

Tetsu & McCormick (1999) Beta-catenin regulates expression of cyclin D1 in colon carcinoma cells. *Nature* 398: 422-426.

Townsend & Bodmer (1989) *Ann Rev Immunol* 7:601-624.

U.S. Patent Application Publication Nos. 2002/0119149; 2005/0277161; 2009/0226474.

U.S. Pat. Nos. 4,361,539; 4,714,681; 4,816,567; 4,816,567; 5,225,539; 5,545,806; 5,545,807; 5,569,825; 5,625,126; 5,633,425; 5,661,016; 5,712,120; 5,861,155; 5,869,619; 5,916,771; 5,939,598; 5,968,509; 6,054,927; 6,180,370; 6,706,265; 6,750,325.

U.S. Provisional Patent Application Ser. Nos. 61/695,776; 61/696,787.

Utz et al. (1997) Proteins phosphorylated during stress-induced apoptosis are common targets for autoantibody production in patients with systemic lupus erythematosus. *J Exp Med* 185:843-854.

van Doorn et al. (2005) Epigenetic profiling of cutaneous T cell lymphoma: promoter hypermethylation of multiple tumor suppressor genes including BCL7a, PTPRG, and p73. *J Clin Oncol* 23:3886-3896.

Van Wauve (1980) *J Immunol* 24:2708-2718.

Verhoeyen et al. (1988) *Science* 239:1534-1536.

Wang et al. (2007) Dynamic interplay between O-linked N-acetylglucosaminylation and glycen synthase kinase-3-dependent phosphorylation. *Mol Cell Proteomics* 6:1365-1379.

Wang et al. (2010) Extensive Crosstalk Between O-GlcNAcylation and Phosphorylation Regulates Cytokinesis, *Sci Signal* 3(104):ra2, including Supplemental Materials.

Watts (1997) *Annu Rev Immunol* 15:821-850.

Waun Ki Hong et al. *Holland-Frei Cancer Medicine* 10 A. D. McGraw-Hill Medical. Ref Type: Edited Book Weber (2002) *Cancer Invest* 20:208-221.

Wong (1990) *Transplantation* 50:683-689.

Worm et al. (2004) Genetic and epigenetic alterations of the APC gene in malignant melanoma. *Oncogene* 23:5215-5226.

Wuttge et al. (1999) T cell recognition of lipid peroxidation products breaks tolerance to self proteins. *Immunol* 98:273-279.

Yasumura et al. (1993) *Cancer Res* 53:1461-1468.

Yee et al. (2002) *Proc Natl Acad Sci USA* 99:16168-16173.

Yenari et al. (1998) *Exp Neurol* 153:223.

Yenari et al. (2001) *Neurol Res* 23:72.

Yewdell (2002) To DRiP or not to DRiP: generating peptide ligands for MHC class I molecules from biosynthesized proteins. *Mol Immunol* 39:139-146.

Yoshino et al. (1994) *Cancer Res* 54:3387-3390.

Yost et al. (1996) The axis-inducing activity, stability, and subcellular distribution of beta-catenin is regulated in *Xenopus* embryos by glycogen synthase kinase 3. *Genes Dev* 10:1443-1454.

Zarling et al. (2000) Phosphorylated peptides are naturally processed and presented by MHC class I molecules in vivo. *J Exp Med* 192:1755-1762.

Zarling et al. (2006) Identification of class I MHC associated phosphopeptides as targets for cancer immunotherapy. *Proc Natl Acad Sci USA* 103:14889-14894.

It will be understood that various details of the presently disclosed subject matter may be changed without departing from the scope of the presently disclosed subject matter. Furthermore, the foregoing description is for the purpose of illustration only, and not for the purpose of limitation.

TABLE 9

Phosphopeptides Presented in Association with Class I and Class II MHC Molecules on Cancer Cells:

| SEQ ID No. | Sequence | Start | Stop | UniProt Accession | Source Protein |
|---|---|---|---|---|---|
| HLA A*0301 Phosphopeptides on Melanoma | | | | | |
| 1 | ALRSsPIMRK | 1168 | 1177 | O43314 | Inositol hexakisphosphate kinase 2 |
| 2 | ALYsGVHKK | 305 | 313 | O94885 | SAM and SH3 domain-containing protein 1 |
| 3 | DTVPLsPLKY | 418 | 427 | Q9UEY8 | Gamma-adducin |
| 4 | EMKKsPTSLK | 134 | 143 | Q9NYZ3 | G2 and S phase-expressed protein 1 |
| 5 | FRYsGKTEY | 345 | 353 | Q9HCM4 | Band 4.1-like protein 5 |
| 6 | FVSKVMIGsPKKV | 1433 | 1445 | Q68CZ2 | Tensin 3 |
| 7 | IISsPLTGK | 461 | 469 | Q9P275 | Ubiquitin thioesterase 36 |
| 8 | ITQGtPLKY | 1459 | 1467 | Q9Y618 | Nuclear receptor corepressor 2 |
| 9 | KGIsSSSLKEK | 616 | 626 | P31629 | Transcription factor HIVEP2 |
| 10 | KIDsPTKVKK | 1008 | 1017 | Q15468 | SCL-interrupting locus protein |
| 11 | KIFsKQQGK | 494 | 502 | Q16513 | S/T-protein kinase N2 |
| 12 | KIRSsPREAK | 36 | 45 | Q9H1E3 | Casein and cyclin-dependent kinases substrate |
| 13 | KIRTsPTFR | 39 | 47 | P62750 | 60S Ribosomal protein L23a |
| 14 | KLFsPAHKK | 458 | 466 | Q8TAT5 | Endonuclease VIII-like 3 |
| 15 | KLRsPFLQK | 280 | 288 | Q9UJU6 | Drebrin-like protein |
| 16 | KLSsPRGGMKK | 212 | 222 | P18124 | 60S Ribosomal protein L7 |
| 17 | KMPTtPVKAK | 47 | 56 | Q8WUA7 | TBC1 domain family member 22A |
| 18 | KRLsVERIY | 26 | 34 | P11388 | DNA topoisomerase 2-alpha |
| 19 | KRFsGTVRL | 47 | 55 | P62906 | 60S Ribosomal protein L10a |
| 20 | KRYsGNMEY | 275 | 283 | O95835 | Serine/threonine-protein kinase LATS1 |
| 21 | KSKsNPDFLKK | 990 | 1000 | Q6WCQ1 | Myosin phosphatase Rho-interacting protein |
| 22 | KSKtPLVAR | 1137 | 1145 | P28290 | Sperm-specific antigen 2 |
| 23 | KSSsLGNLKK | 463 | 472 | Q86W92 | Liprin-beta-1 |
| 24 | KtLSPGKNGVVK | 1171 | 1182 | P04626 | Receptor tyrosine-protein kinase erbB-2 |
| 25 | KTPTsPLKMK | 112 | 121 | O60264 | SWI/SNF-related regulator of chromatin subfamily A, # 5 |
| 26 | KVHGsLARAGK | 1 | 11 | P62861 | 40S Ribosomal protein S30 |
| 27 | KVLtPIKEK | 365 | 373 | Q8N960 | Centrosomal protein of 120 kDa |

TABLE 9-continued

Phosphopeptides Presented in Association with Class I and Class II MHC Molecules on Cancer Cells:

| SEQ ID No. | Sequence | Start | Stop | UniProt Accession | Source Protein |
|---|---|---|---|---|---|
| 28 | KVHGsLARAGK | 1 | 11 | P62861 | 40S Ribosomal protein S30 |
| 29 | KLNKSsPVKK | 552 | 561 | O60318 | 80 kDa MCM3-associated protein |
| 30 | MTRsPPRVSK | 249 | 258 | Q9BRL6 | Splicing factor, R/S-rich 2B |
| 31 | NYVERKNsL | 54 | 62 | O43639 | Cytoplasmic protein NCK2 |
| 32 | QVFsPKKGQK | 990 | 999 | Q5T200 | Zinc finger CCCH domain-containing protein 13 |
| 33 | RAFsFSKTPK | 808 | 817 | Q9H8V3 | Protein ECT2 |
| 34 | RILsPSMASK | 68 | 77 | Q9Y6A5 | Transforming acidic coiled-coil-containing protein 3 |
| 35 | RIYQyIQSR | 269 | 277 | Q9Y463 | Dual specificity Tyr-phosphorylation-regulated kinase 1B |
| 36 | RIQyIQSRF | 269 | 278 | Q9Y463 | Dual specificity Tyr-phosphorylation-regulated kinase 1B |
| 37 | RIQy IQSRFY | 269 | 279 | Q9Y463 | Dual specificity Tyr-phosphorylation-regulated kinase 1B |
| 38 | RKLsVILIL | 3 | 11 | Q13433 | Zinc transporter ZIP6 |
| 39 | RLIsPYKKK | 358 | 366 | O14929 | Histone acetyltransferase type B catalytic subunit |
| 40 | RLKsPFRKK | 206 | 214 | Q92963 | GTP-binding protein Rit1 |
| 41 | RLLDRSPsRSAK | 301 | 312 | O76039 | Cyclin-dependent kinase-like 5 |
| 42 | RLPsSTLKR | 813 | 821 | Q86Y91 | Kinesin-like protein KIF18B |
| 43 | RLRsAGAAQK | 38 | 47 | Q6PL18 | ATPase family AAA domain-containing protein 2 |
| 44 | RLSsPISKR | 327 | 335 | Q99728 | BRCA1-associated RING domain protein 1 |
| 45 | RLSsPVLHR | 139 | 147 | Q16643 | Drebrin |
| 46 | RLSsRYSQK | 154 | 162 | Q8WUB2 | Uncharacterized protein C12orf24 |
| 47 | RMYsKSRDH | 663 | 671 | Q13427 | Peptidyl-prolyl cis-trans isomerase G |
| 48 | RRPsLVHGY | 31 | 39 | P14324 | Farnesyl pyrophosphate synthetase: FPP synthetase |
| 49 | RSAsSATQVHK | | | | No database hit |
| 50 | RSLsVEIVY | 863 | 871 | Q9NS56 | E3 Ubiquitin-protein ligase Topors |
| 51 | RSMsMPVAH | 429 | 437 | Q9Y4H2 | Insulin receptor substrate 2, IRS-2 |
| 52 | RSRRsPLLK | 874 | 882 | O95235 | Kinesin-like protein KIF20A |
| 53 | RSRsPPPVSK | 188 | 197 | Q01130 | Splicing factor, R/S-rich 2 |
| 54 | RSRTsPITRR | 1971 | 1980 | Q9UQ35 | S/R repetitive matrix protein 2 |
| 55 | RSSsLIRHK | 388 | 396 | P17029 | Zinc finger protein with KRAB and SCAN domains 1 |
| 56 | RSVsLSMRK | 163 | 171 | O60238 | BCL2/adenovirus E1B 19 kDa interacting protein 3-like |
| 57 | RSYsGSRsR | 189 | 197 | Q13247 | Splicing factor, R/S-rich 6 |
| 58 | RSYsPDHRQK | 122 | 131 | Q14241 | Transcription elongation factor B polypeptide 3 |
| 59 | RSYsPERSK | 152 | 160 | Q8NEY8 | Periphilin-1 (gastric cancer antigen Ga50) |
| 60 | RSYsPRNSR | 140 | 148 | O75494 | Splicing factor, R/S-rich 13A |
| 61 | RSYsYPRQK | 648 | 656 | Q9H706 | Protein FAM59A |
| 62 | RSYVTTSTRTYsLG | 28 | 41 | P08670 | Vimentin |
| 63 | RTPsFLKKNK | 690 | 699 | Q9UEY8 | Gamma-adducin |
| 64 | RTYKsPLRH | 175 | 183 | Q6ICC9 | Protein LDOC1L |

TABLE 9-continued

Phosphopeptides Presented in Association with Class I and Class II MHC Molecules on Cancer Cells:

| SEQ ID No. | Sequence | Start | Stop | UniProt Accession | Source Protein |
|---|---|---|---|---|---|
| 65 | RVAsPTSGVK | 1097 | 1106 | Q9Y4H2 | Insulin receptor substrate 2 |
| 66 | RVAsPTSGVKR | 1097 | 1107 | Q9Y4H2 | Insulin receptor substrate 2 |
| 67 | RVKLPsGSKK | 147 | 156 | P62917 | 60S Ribosomal protein L8 |
| 68 | RVKsPGsGHVK | 437 | 447 | Q9C040 | Tripartite motif-containing protein 2 |
| 69 | RVKsPSPKSER | 943 | 953 | O15042 | U2-associated protein SR140 |
| 70 | RVKtPTSQSYR | 885 | 895 | Q9Y2X9 | Zinc finger protein 281 |
| 71 | RVKTtPLRR | 658 | 666 | P46100 | Transcriptional regulator ATRX |
| 72 | RVRQsPLATR | 40 | 49 | O75381 | Peroxisomal membrane protein PEX14 |
| 73 | RVYsPYNHR | 582 | 590 | Q9NS56 | E3 ubiquitin-protein Topors |
| 74 | SLFsPRRNK | 841 | 849 | O94909 | Protein MICAL-3 |
| 75 | SLLNKSsPVKK | 551 | 561 | O60318 | 80 kDa MCM3-associated protein |
| 76 | SLMsPGRRK | 204 | 212 | Q14207 | Protein NPAT |
| 77 | SVKsPVTVK | 329 | 337 | Q9HCS4 | Transcription factor 7-like 1 |
| 78 | SVRRsVLMK | 223 | 231 | Q9H2J4 | Phosducin-like protein 3 |
| 79 | SVYsPVKKK | 136 | 144 | O15504 | Nucleoporin-like 2 |
| 80 | VMIGsPKKV | 1437 | 1445 | Q68CZ2 | Tensin 3 |
| 81 | VSKVMIGsPKKV | 1434 | 1445 | Q68CZ2 | Tensin 3 |
| 82 | VTQtPPYVKK | 451 | 460 | Q659C4 | La-related protein 1B |
| | HLA-A*0101 Phosphopeptides on Melanoma | | | | |
| 83 | AEEEIGtPRKF | 326 | 336 | P28749 | Retinoblastoma-like protein 1 |
| 84 | DTVPLsPLKY | 418 | 427 | Q9UEY8 | Gamma-adducin |
| 85 | ESEsLPRY | 447 | 454 | Q8TD91 | Melanoma-associated antigen C3 |
| 86 | FIEsPSKL | 1104 | 1111 | Q6N021 | Methylcytosine dioxygenase TET2 |
| 87 | FSSsHEGFSY | 318 | 327 | P41161 | ETS translocation variant 5 |
| 88 | FSsSHEGFSY | 318 | 327 | P41162 | ETS translocation variant 5 |
| 89 | GEEsSDDGKKY | 135 | 145 | Q9P2B7 | UPF0501 protein KIAA1430 |
| 90 | GtLPKY | 291 | 296 | P12271 | Retinaldeyhde-binding protein |
| 91 | IIEtPHKEI | 71 | 79 | O96020 | G1/S-specific cyclin-E2 |
| 92 | ISFSAHtDY | 391 | 399 | Q9UKF6 | Cleavage and polyadenylation specificity factor subunit 3 |
| 93 | ISSsMHSLY | 222 | 230 | P50616 | Protein Tob1 |
| 94 | ITQGtPLKY | 1459 | 1467 | Q9Y618 | Nuclear receptor corepressor 2 |
| 95 | IVRyHQL | 71 | 77 | A6NC51 | Transmembrane protein 150B |
| 96 | IVtDRDPL | 514 | 521 | Q92932 | Receptor-type Y-protein phosphatase N2 |
| 97 | KSEsRQERY | 146 | 154 | Q05682 | Caldesmon |
| 98 | LLDPSRSYsY | 643 | 652 | Q9H706 | Protein FAM59A |
| 99 | LLDtPVKTQY | 1119 | 1128 | Q6N021 | Probable methylcytosine dioxygenase TET2 |
| 100 | LSDsDTEAKL | 2040 | 2049 | Q92614 | Myosin-XVIIIa |

TABLE 9-continued

Phosphopeptides Presented in Association with Class I and Class II MHC Molecules on Cancer Cells:

| SEQ ID No. | Sequence | Start | Stop | UniProt Accession | Source Protein |
|---|---|---|---|---|---|
| 101 | MTDtYRLKY | 1045 | 1053 | Q70EK8 | Inactive ubiquitin carboxyl-terminal hydrolase 53 |
| 102 | NTDsPLRY | 149 | 156 | P08865 | 40S Ribosomal protein SA |
| 103 | QLDsPQRALY | 59 | 68 | Q16587 | Zinc finger protein 74 |
| 104 | RGDsPKIDL | 433 | 441 | Q96B97 | SH3 domain-containing kinase-binding protein 1 |
| 105 | RRLsFLVSY | 67 | 75 | P47897 | Glutamine-tRNA synthetase |
| 106 | RSDsRAQAV | 116 | 124 | P55884 | Eukaryotic translation initiation factor 3 subunit B |
| 107 | RSDsYVELSQY | 10 | 20 | P52298 | Nuclear cap-binding protein subunit 2 |
| 108 | RSIsVGENL | 1260 | 1268 | O60336 | Mitogen-activated protein kinase-binding protein 1 |
| 109 | RTEPSKsPGSLRY | 695 | 707 | Q9UGU0 | Transcription factor 20 |
| 110 | SIDsPQKL | 724 | 731 | Q12888 | Tumor suppressor p53-binding protein 1 |
| 111 | SLDsPSYVLY | 57 | 66 | P49354 | Protein farnesyltransferase type-1 subunit alpha |
| 112 | SREKHsEI | 64 | 71 | Q9HBZ2 | Aryl hydrocarbon receptor nuclear translocator 2 |
| 113 | SSDPASQLsY | 581 | 590 | Q08050 | Foxhead box protein M1 |
| 114 | SSDsPTNHFF | 850 | 859 | Q15648 | Mediator of RNA polymerase II transcription subunit 1 |
| 115 | STDsETLRY | 281 | 289 | Q9HCH5 | Synaptotagmin-like protein 2 |
| 116 | SVDIsPTRL | 690 | 698 | Q9P2Q2 | FERM domain-containing protein 4A |
| 117 | TMAsPGKDNY | 3 | 12 | O60684 | Importin subunit alpha-7 |
| 118 | TSEtPDYLLKY | 503 | 513 | P55199 | RNA polymerase II elongation factor ELL |
| 119 | VSKVMIGsPKKV | 1434 | 1445 | Q68CZ2 | Tehsin 3 |
| HLA-B*4402 Phosphopeptides on Melanoma ||||||
| 120 | AEEEIGtPRKF | 326 | 336 | P28749 | Retinoblastoma-like protein 1 |
| 121 | AENsPTRQQF | 93 | 102 | Q86XP3 | ATP-dependent RNA helicase DDX42 |
| 122 | AESsPTAGKKL | 799 | 809 | Q8IWB9 | Testis-expressed sequence 2 protein |
| 123 | AtAGPRLGW | 621 | 629 | Q86W92 | Liprin-beta-1 |
| 124 | DERLRINsL | 49 | 57 | O60783 | 28S Ribosomal protein S14, mitochondrial |
| 125 | DQFERIKtL | 42 | 50 | P17612 | cAMP-dependent protein kinase catalytic subunit alpha |
| 126 | DQISHRAsL | 277 | 285 | Q7Z2W4 | Zinc finger CCCH-type antiviral protein 1 |
| 127 | EEsSDDGKKY | 136 | 145 | Q9P2B7 | UPF0501 protein KIAA1430 |
| 128 | EESsDDGKKY | 136 | 145 | Q9P2B7 | UPF0501 protein KIAA1430 |
| 129 | GEEsSDDGKKY | 135 | 145 | Q9P2B7 | UPF0501 protein KIAA1430 |
| 130 | KEMsPTRQL | 36 | 44 | Q4G0N7 | UPF0731 protein C6orf225 |
| 131 | RQKsPLFQF | 240 | 248 | Q8WY36 | HMG box transcription factor BBX |
| 132 | SEGsLHRKY | 81 | 89 | Q9ULM0 | Pleckstrin homology domain-containing family H, #1 |
| HLA-B*2705 Phosphopeptides on Melanoma ||||||
| 133 | ARFsPDDKYSR | 33 | 43 | Q9NPE3 | H/ACA ribonucleoprotein complex subunit 3 |
| 134 | FRYsGKTEY | 345 | 353 | Q9HCM4 | Band 4.1-like protein 5 |
| 135 | GRKsPPPSF | 713 | 721 | B4DLE8 | cDNA FLJ60082, similar to Uro-adherence factor A |

TABLE 9-continued

Phosphopeptides Presented in Association with Class I and Class II MHC Molecules on Cancer Cells:

| SEQ ID No. | Sequence | Start | Stop | UniProt Accession | Source Protein |
|---|---|---|---|---|---|
| 136 | GRLGsPHRR | 109 | 117 | Q6UUV9 | CREB-regulated transcription coactivator 1 |
| 137 | GRLsPKASQVK | 1078 | 1088 | Q8IVL1 | Neuron navigator 2 |
| 138 | GRLsPVPVPR | 132 | 141 | Q9UKM9 | RNA-binding protein Raly |
| 139 | GRSsTASLVKR | 558 | 568 | O15213 | WD repeat-containing protein 46 |
| 140 | HRLsPVKGEF | 367 | 376 | Q9Y2L9 | Leucine-rich repeat and calponin homology domain-containing protein 1 |
| 141 | HRNsNPVIAEL | 267 | 277 | Q8IZ21 | Phosphatase and actin regulator 4 |
| 142 | KRAsGQAFEL | 13 | 22 | P16949 | STMN1, Stathman, leukemia associated phosphoprotein p18/metablastin |
| 143 | KRAsFAKSV | 349 | 357 | A6PVV2 | WNK lysine deficient protein kinase 2 |
| 144 | KRASsPFRR | 619 | 627 | Q14978 | Nucleolar and coiled-body phosphoprotein 1 |
| 145 | KRAsVFVKL | 153 | 161 | P50502 | Hsc70-interacting protein |
| 146 | KRFsFKK | 156 | 162 | P29966 | Myristoylated A-rich C-kinase substrate |
| 147 | KRFsFKKSF | 156 | 162 | P29966 | Myristoylated A-rich C-kinase substrate |
| 148 | KRFsGTVRL | 47 | 55 | P62906 | 60S Ribosomal protein L10a |
| 149 | KRLsPAPQL | 51 | 59 | Q9UH99 | SUN domain-containing protein 2 |
| 150 | KRLsVERIY | 26 | 34 | P11388 | DNA topoisomerase 2-alpha |
| 151 | KRMsPKPL | 17 | 25 | P41208 | Centrin-2 |
| 152 | KRYsGNMEY | 275 | 283 | O95835 | S/T-protein kinase LATS1 |
| 153 | MRLsRELQL | 360 | 368 | Q15051 | IQ calmodulin-binding motif-containing protein 1 |
| 154 | NRYtNRVVTL | 183 | 192 | P50750 | Cell division protein kinase 9 |
| 155 | RRFsPPRRM | 248 | 256 | Q15287 | RNA-binding protein with serine-rich domain 1 |
| 156 | RRFsRSPIR | 2026 | 2034 | P18583 | Protein SON |
| 157 | RRFsRsPIR | 2026 | 2034 | P18583 | Protein SON |
| 158 | RRFsRSPIRR | 2026 | 2035 | P18583 | Protein SON |
| 159 | RRFsRsPIRR | 2026 | 2035 | P18583 | Protein SON |
| 160 | RRIsGVDRY | 52 | 60 | O15239 | NADH dehydrogenase 1 α subcomplex subunit 1 |
| 161 | RRIsGVDRYY | 52 | 61 | O15239 | NADH dehydrogenase 1 α subcomplex subunit 1 |
| 162 | RRKsQLDSL | 159 | 167 | Q14693 | Phosphatidate phosphatase LPIN1 |
| 163 | RRKsQVAEL | 244 | 252 | Q9BYG3 | MKI67 FHA domain-interact nucleolar phosphoprotein |
| 164 | RRLsADIRL | 744 | 752 | O60307 | Microtubule-associated S/T-protein kinase 3 |
| 165 | RRLsFLVSY | 67 | 75 | P47897 | Glutaminyl-tRNA synthetase |
| 166 | RRLsGGSHSY | 332 | 341 | Q13905 | Rap guanine nucleotide exchange factor 1 |
| 167 | RRLsGPLHTL | 610 | 619 | Q86Y91 | Kinesin-like protein KIF18B |
| 168 | RRMsLLSVV | 314 | 322 | Q9ULI2 | Ribosomal protein S6 modification-like protein B |
| 169 | RRNsSERTL | 591 | 599 | P57058 | Hormonally up-regulated neu tumor-associated kinase |
| 170 | RRNsSIVGR | 436 | 444 | Q96N67 | Dedicator of cytokinesis protein 7 |
| 171 | RRNsVFQQGM | 937 | 946 | P50993 | Na+/K+ ATPase alpha-2 subunit |

TABLE 9-continued

Phosphopeptides Presented in Association with Class I and Class II MHC Molecules on Cancer Cells:

| SEQ ID No. | Sequence | Start | Stop | UniProt Accession | Source Protein |
|---|---|---|---|---|---|
| 172 | RRPsLVHGY | 31 | 39 | P14324 | Farnesyl pyrophosphate synthase |
| 173 | RRPsVFERL | 22 | 30 | Q5T200 | Zinc finger CCCH domain-containing protein 13 |
| 174 | RRPsYRKIL | 60 | 68 | P18846 | Cyclic AMP-dependent transcription factor ATF-1 |
| 175 | RRPsYTLGM | 1629 | 1637 | O43166 | Signal-induced proliferation-associated 1-like protein 1 |
| 176 | RRSsFLQVF | 585 | 593 | Q15436 | Protein transport protein Sec23A |
| 177 | RRSsIGLRV | 136 | 144 | Q96GN5 | Cell division cycle-associated 7-like protein |
| 178 | RRSsIQSTF | 232 | 240 | Q92542 | Nicastrin |
| 179 | RRSsQSWSL | 29 | 37 | Q9Y4E1 | WASH complex subunit FAM21C |
| 180 | RRSsVDLGL | 61 | 69 | Q96J92 | S/T-protein kinase WNK4 |
| 181 | RRsSVDLGL | 61 | 69 | Q96J92 | S/T-protein kinase WNK4 |
| 182 | RRSsVKVEA | 512 | 520 | Q15742 | NGFI-A-binding protein 2 |
| 183 | RRVVQRSsL | 1139 | 1147 | Q04637 | Eukaryotic translation initiation factor 4 gamma 1 |
| 184 | RRYsPPIQR | 594 | 602 | Q8IYB3 | S/R repetitive matrix protein 1 |
| 185 | SRLTHLsL | 83 | 90 | P30305 | M-phase inducer phosphatase 2 |
| 186 | SRMsPKAQR | 406 | 414 | Q8WWM7 | Ataxin-2-like protein |
| 187 | SRTsPITRR | 1972 | 1980 | Q9UQ35 | S/R repetitive matrix protein 2 |
| 188 | SRYSRsPYSR | 168 | 177 | Q9BRL6 | Splicing factor, R/S-rich 2B |
| 189 | SRYsRSPYSR | 168 | 177 | Q9BRL6 | Splicing factor, R/S-rich 2B |
| 190 | SRYsRsPYSR | 168 | 177 | Q9BRL6 | Splicing factor, R/S-rich 2B |
| HLA-B*1402 Phosphopeptides on Melanoma | | | | | |
| 191 | MRLsRELQL | 360 | 368 | Q15051 | IQ Calmodulin-binding motif containing protein 1 |
| 192 | RSIsVGENL | 1260 | 1268 | O60336 | Mitogen-activated protein kinase-binding protein 1 |
| 193 | RSRsPLEL | 23 | 30 | Q92466 | DNA damage-binding protein 2 |
| 194 | SPFKRQLsL | 288 | 296 | P49757 | Protein numb homolog |
| 195 | SRLTHLsL | 83 | 90 | P30305 | M-Phase inducer phosphatase 2 |
| HLA A*0301 Phosphopeptides on Transformed B-Cells | | | | | |
| 196 | ATYtPQAPK | 251 | 259 | Q53GL0 | Pleckstrin homology domain-containing family O member 1 |
| 197 | GTIRSRsFIFK | 270 | 280 | Q9JUN19 | Dual adapter for phosphotyrosine 3-phosphotyrosine and 3-phosphoinositide |
| 198 | KLPDsPALAK | 571 | 580 | Q13586 | Stromal interaction molecule 1 |
| 199 | KLPDsPALAKK | 571 | 581 | Q13586 | Stromal interaction molecule 1 |
| 200 | KMPTtPVKAK | 47 | 56 | Q8WUA7 | TBC1 Domain family member 22A |
| 201 | KTPTsPLKMK | 112 | 121 | O60264 | SWI/SNF-Related matrix-assoc actin-dependent regulator of chromatin subfamily A member 5 |
| 202 | KVKSsPLIEKL | 79 | 89 | Q6JBY9 | CapZ-interacting protein |
| 203 | KVLtPIKEK | 365 | 373 | Q8N960 | Centrosomal protein of 120 kDa |
| 204 | RAKsPISLK | 509 | 517 | Q9BXL7 | Caspase recruitment domain-containing protein 1 |
| 205 | RILsGVVTK | 71 | 79 | P62280 | 40S Ribosomal protein S11 |

TABLE 9-continued

Phosphopeptides Presented in Association with Class I and Class II MHC Molecules on Cancer Cells:

| SEQ ID No. | Sequence | Start | Stop | UniProt Accession | Source Protein |
|---|---|---|---|---|---|
| 206 | RIYQyIQSR | 269 | 277 | Q9Y463 | Dual specificity tyrosine-phosphorylation-regulated kinase 1B |
| 207 | RIYQyIQSRF | 269 | 278 | Q9Y463 | Dual specificity tyrosine-phosphorylation-regulated kinase 1B |
| 208 | RIYQyIQSRFY | 269 | 279 | Q9Y463 | Dual specificity tyrosine-phosphorylation-regulated kinase 1B |
| 209 | RLLDRSPsRSAK | 301 | 312 | Q76039 | Cyclin-dependent kinase-like 5 |
| 210 | RLPsSTLKR | 813 | 821 | Q86Y91 | Kinesin-like protein KIF18B |
| 211 | RLSsPISKR | 327 | 335 | Q99728 | BRCA1-Associated ring domain protein 1 |
| 212 | RQAsPLVHR | 161 | 169 | Q9UGI6 | Small conductance calcium-activated potassium channel protein 3 |
| 213 | RSVsLSMRK | 163 | 171 | O60238 | BLC2/Adenovirus E1B 19 kDa protein-interacting protein 3-like |
| 214 | RSYSRsFSR | 713 | 721 | Q7Z6E9 | E3 Ubiquitin-protein ligase RBBP6 |
| 215 | RTAsFAVRK | 249 | 248 | Q9Y512 | Sorting and assembly machinery component 50 homolog |
| 216 | RTAsPPPPK | 613 | 622 | Q8IYB3 | A/R Repetitive matrix protein 1 |
| 217 | RTRsLSSLREK | 1975 | 1985 | O94915 | Protein fury homolog-like |
| 218 | RVRQsPLATR | 40 | 49 | O75381 | Peroxisomal membrane protein PEX14 |
| 219 | RVSsRFSSR | 48 | 56 | Q9BUV0 | UPF0471 protein C1orf63 |
| 220 | RVSsVKLISK | 259 | 268 | P30559 | Oxytocin receptor |
| 221 | RVYsPYNHR | 582 | 590 | Q9NS56 | E3 Ubiquitin-protein Topors |
| 222 | SVRRsVLMK | 223 | 231 | Q9H2J4 | Phosducin-like protein 3 |
| | HLA B*0702 Phosphopeptides on Transformed B-Cells | | | | |
| 223 | GPRPGsPSAL | 276 | 286 | Q9UJJ7 | RNA pseudouridylate synthase domain-containing protein 1 |
| 224 | HPRsPNVLSV | 684 | 693 | Q16665 | Hypoxia-inducible factor 1-alpha |
| 225 | KPRsPPRAL | 249 | 257 | Q86TG7 | Retrotransposon-derived protein PEG10 |
| 226 | KPRsPPRALVL | 249 | 259 | Q86TG7 | Retrotransposon-derived protein PEG10 |
| 227 | KPRsPPRALVLP | 249 | 260 | Q86TG7 | Retrotransposon-derived protein PEG10 |
| 228 | KPRsPVVEL | 667 | 675 | P25098 | Beta-adrenergic receptor Kinase 1 |
| 229 | LPAsPHQL | 998 | 1005 | Q8TEK3 | Histone lysine (H3-K79) N-methyl transferase |
| 230 | LPIFSRLsI | 483 | 491 | P47974 | Zince finger protein 36, C3H1 type-like 2 |
| 231 | LPKsPPYTAF | 90 | 99 | P23588 | Eukaryotic translation initiation factor 4B |
| 232 | MPRQPsATRL | 134 | 143 | Q6NZ67 | Mitotic-spindle organizing protein 2B |
| 233 | RPAsAGAML | 198 | 2006 | Q14814 | Myocyte-specific enhancer factor 2D |
| 234 | RPKsNIVLL | 222 | 230 | P11836 | B-Lymphocyte antigen CD20 |
| 235 | RPNsPSPTAL | 185 | 194 | Q9UK18 | S/T-Protein kinase tousled-like 1 |
| 236 | RPRsISVEEF | 1143 | 1152 | Q7Z333 | Probably helicase senataxin |
| 237 | RPRsPPPRAP | 499 | 508 | O43900 | Prickle-like protein 3 |
| 238 | RPRsPRQNSI | 689 | 698 | Q99700 | Ataxin-2 |

TABLE 9-continued

Phosphopeptides Presented in Association with Class I and Class II MHC Molecules on Cancer Cells:

| SEQ ID No. | Sequence | Start | Stop | UniProt Accession | Source Protein |
|---|---|---|---|---|---|
| 239 | RPRPVsPSSL | 430 | 439 | P57059 | Serine/threonine-protein kinase SIK1 |
| 240 | RPYsPPFFSL | 187 | 196 | Q9NYF3 | Protein FAM53C |
| 241 | SPGsPRPAL | 391 | 399 | Q9H211 | DNA Replication factor Cdt1 |
| 242 | SPRRsRSISL | 159 | 168 | Q16629 | S/R-Rich splicing factor 7 |
| 243 | SPRsPSTTYL | 772 | 781 | Q13111 | Chromatin assembly factor 1 subunit A |
| 244 | VPREVLRLsL | 1162 | 1171 | Q7Z591 | AT-Hook-containing transcription factor |
| HLA A*0101 Phosphopeptides on Transformed B-Cells ||||||
| 245 | ITQGtLKY | 1459 | 1467 | Q9Y618 | Nuclear receptor corepressor 2 |
| 246 | NTDsPLRY | 149 | 156 | P08865 | 40S Ribosomal protein SA |
| 247 | QLDsPQRALY | 59 | 68 | Q16587 | Zinc finger protein 74 |
| 248 | RQAsIELPSM | 249 | 258 | P33241 | Lyphocyte-specific protein 1 |
| HLA B*2705 Phosphopeptides on Transformed B-Cells ||||||
| 249 | HRLsPVKGEF | 367 | 376 | Q9Y2L9 | Leucine-rich repeat and calponin homology domain-containing protein 1 |
| 250 | KRFsFKKSF | 156 | 164 | P29966 | Myristoylated A-rich C-kinase substrate |
| 251 | KRLsPAPQL | 51 | 59 | Q9UH99 | SUN domain-containing protein 2 |
| 252 | KRMsPKEL | 17 | 25 | P41208 | Centrin-2 |
| 253 | RRAsLSEIGF | 177 | 186 | Q00537 | Cyclin-dependent kinase 17 |
| 254 | RRDsIVAEL | 96 | 104 | O14579 | Coatomer subunit epsilon |
| 255 | RRFtPPSPAF | 11 | 20 | Q13761 | Runt-related transcription factor 3 |
| 256 | RRFsRSPIR | 2026 | 2034 | P18583 | SON3, DNA-binding protein 5, BASS1 |
| 257 | RRFsRsPIR | 2026 | 2034 | P18583 | SON3, DNA-binding protein 5, BASS1 |
| 258 | RRFsRsPIRR | 2026 | 2034 | P18583 | SON3, DNA-binding protein 5, BASS1 |
| 259 | RRIDIsPSTF | 677 | 686 | Q9Y2W1 | Thyroid hormone receptor-associated protein 3 |
| 260 | RRIsGVDRYY | 52 | 60 | O15239 | NADH dehydrogenase (ubiquinone) 1 α subcomplex subunit 1 |
| 261 | RRLsNLPTV | 36 | 44 | Q86U86 | Protein polybromo 1 |
| 262 | RRMsLLSVV | 314 | 322 | Q9ULI2 | Beta-citryl-glutamate synthase B |
| 263 | RRYsPPIQR | 594 | 602 | Q8IYB3 | S/R repetitive matrix protein 1 |
| 264 | SRWsGSHQF | 602 | 610 | P15056 | BRAF/serine/threonine-protein kinase B-raf |
| 265 | TRLsPAKIVLR | 772 | 782 | Q8TEK3 | Histone-lysine N-methyltransferase, H3 lysine-79 specific |

Column 2 Phosphopeptide sequences; pSer, pThr and pTyr are specified by s, t, and y, respectively.

Columns 3 & 4: Entries define the amino acid positions of the phosphopeptides within the sequence of the parent protein (identified in Column 5 by accession identifier in the UniProt protein sequence database Column 6: Name of the parent protein as per the UniProt protein sequence database.

TABLE 10

Phosphopeptides Presented in Association with Class I and Class II
MHC Molecules on Cancer Cells: HLA-B*0702 Phosphopeptides on
Melanoma (M) and/or Leukemia (L)

| SEQ ID No. | Sequence | Start | Stop | L/M | UniProt | Source Protein |
|---|---|---|---|---|---|---|
| 266 | APRKGsF SALM | 5 | 14 | M | Q13619 | Cullin-4A |
| 267 | APRRYsSSL | 697 | 705 | L/M | Q68EM7 | Rho GTPase-activating protein 17 |
| 268 | APRsPPPSRP | 8 | 17 | M | Q9NSA8 | SOC S-1/Suppressor of cytokine signaling protein |
| 269 | EPKRRsARL | 15 | 23 | L | P82970 | Nucleosome-binding domain-containing protein 5 |
| 270 | EPRsPSHSM | 746 | 754 | L | Q03164 | Histone-lysine N-methyltransferase MLL |
| 271 | FPHsLLSVI | 662 | 670 | M | Q9H9Y6 | DNA-directed RNA polymerase I 135 kDa polypeptides/POLR1B |
| 272 | FRRsPTKSSL | 624 | 633 | L | Q96PK6 | RNA-binding protein 14 |
| 273 | FRRsPTKSSLDY | 624 | 635 | L | Q96PK6 | RNA-binding protein 14 |
| 274 | FSIsPVRL | 2010 | 2017 | L | P18583 | Protein SON |
| 275 | GAQPGRHsV | 256 | 264 | M | Q96IF1 | Ajuba (a novel LIM protein required for mitotic commitment) |
| 276 | GPRSAsLLsL | 51 | 60 | L | Q9Y4H4 | G-protein-signaling modulator 3 |
| 277 | GPRSASLLsL | 51 | 60 | M | Q9Y4H4 | G-protein-signaling modulator 3 |
| 278 | GPRsAsLLSL | 51 | 60 | M | Q9Y4H4 | G-protein-signaling modulator 3 |
| 279 | HPRsPTPTL | 341 | 349 | M | Q96HE9 | Proline rich protein 11 |
| 280 | HPRSPtPTL | 341 | 349 | M | Q96HE9 | Proline rich protein 11 |
| 281 | KARsPGRAL | 6 | 14 | M | Q14767 | Latent transforming growth factor-beta-binding protein-2 |
| 282 | KPAsPARRL | 2614 | 2622 | L | P78559 | Microtubule associated protein 1 (MAP1) |
| 283 | KPAsPKFIVTL | 512 | 522 | L | Q6PJT7 | Zinc finger CCCH domain-containing protein 14 |
| 284 | KPPHsPLVL | 289 | 297 | L | P01106 | Myc proto-oncogene protein |
| 285 | KPPsPEHQSL | 653 | 662 | L | Q9Y6X9 | MORC family CW-type zinc finger protein 2 |
| 286 | KPPsPSPIEM | 83 | 92 | L | Q9H165 | B-cell lymphoma/leukemia 11A |
| 287 | KPPtPGASF | 1734 | 1742 | L | Q96T58 | Msx2-interacting protein |
| 288 | KPPYRSHsL | 442 | 450 | L | Q96GE4 | Coiled-coil domain-containing protein 45 |
| 289 | KPQTRGKtF | 408 | 416 | L | Q8IV04 | Carabin |
| 290 | KPRPPPLsP | 328 | 336 | M | Q15162 | Cdc42-interacting protein 4 |
| 291 | KPRsPDHVL | 859 | 867 | L | Q9UPN3 | Microtubule-actin cross-linking factor 1 |
| 292 | KPRsPPRAL | 249 | 257 | L/M | Q86TG8 | Retrotransposon-derived protein PEG11 |
| 293 | KPRsPPRALV | 249 | 258 | L/M | Q86TG8 | Retrotransposon-derived protein PEG11 |
| 294 | KPRsPPRALVL | 249 | 259 | L/M | Q86TG9 | Retrotransposon-derived protein PEG12 |
| 295 | KPRsPVVEL | 667 | 675 | L/M | P25098 | Beta-Adrenergic receptor kinase 1 |
| 296 | KPYsPLASL | 70 | 78 | L | Q13469 | Nuclear factor of activated T-cells, cytoplasmic 2 |
| 297 | LPAsPRARL | 443 | 451 | L | Q3KQU3 | Map 7 domain-containing protein 1 |
| 298 | LPIFSRLsI | 483 | 491 | L | P47974 | Zinc finger protein 36, C3H1 type-like 2 |
| 299 | LPKsPPYTAF | 90 | 99 | M | P23588 | Eukaryotic translation initiation factor 4B |
| 300 | LPRGSsPSVL | 105 | 114 | M | Q9GZN2 | TGF-beta-induced transcription factor 2 |
| 301 | MPRQPsATRL | 134 | 143 | M | Q6P582 | Mitotic-spindle organizing protein 2A |
| 302 | QPRsPGPDYSL | 17 | 27 | L | Q99684 | Zinc finger protein GE-1 |

TABLE 10-continued

Phosphopeptides Presented in Association with Class I and Class II
MHC Molecules on Cancer Cells: HLA-B*0702 Phosphopeptides on
Melanoma (M) and/or Leukemia (L)

| SEQ ID No. | Sequence | Start | Stop | L/M | UniProt | Source Protein |
|---|---|---|---|---|---|---|
| 303 | QPRtPsPLVL | 172 | 181 | L | P33241 | Lymphocyte-specific protein 1 |
| 304 | QPRtPSPLVL | 172 | 181 | L | P33241 | Lymphocyte-specific protein 1 |
| 305 | RAPsPSSRM | 2423 | 2431 | L | Q9UQ35 | Serine/arginine repetitive matrix protein 2 |
| 306 | RPAKsMDSL | 323 | 331 | L | Q7Z6I6 | Rho GTPase-activating protein 30 |
| 307 | RPAsAGAML | 198 | 206 | L | Q14814 | Monocyte-specific enhancer factor 2D |
| 308 | RPAsARAQPGL | 57 | 67 | L/M | Q9NPB0 | Uncharacterized protein C6orf64 |
| 309 | RPAsPAAKL | 512 | 520 | M | Q9P2N6 | KIAA1310 |
| 310 | RPAtGGPGVA | 71 | 80 | L | Q86TW6 | Unknown protein |
| 311 | RPAtPTSQF | | | M | | Unknown protein |
| 312 | RPDsRLGKTEL | 1225 | 1235 | L | Q9BYW2 | Histone-lysine N-methyltransferase, SETD2 |
| 313 | RPFsPREAL | 742 | 750 | L | Q86V48 | Leucine zipper protein 1 |
| 314 | RPHsPEKAF | 497 | 505 | L | Q53F19 | Uncharacterized protein C17orf85 |
| 315 | RPItPPRNSA | 317 | 326 | L | P62136 | Ser/Thr-protein phosphatase PP1-alpha, catalytic subunit |
| 316 | RPIsPGLSY | 364 | 372 | L | Q16204 | Coiled-coil domain containing protein 6 |
| 317 | RPKLSsPAL | 15 | 23 | L | Q09472 | Histone acetyltransferase p300 |
| 318 | RPKPSSsPV | 183 | 191 | L | Q15366 | Poly(rC)-binding protein 2 |
| 319 | RPNsPSPTAL | 185 | 194 | L | Q9UKI8 | Serine/threonine-protein kinase tousled-like 1 |
| 320 | RPPPPPDtPP | 166 | 175 | L | Q9Y5W3 | Krueppel-like factor 2 |
| 321 | RPPsPGPVL | 934 | 942 | L | Q12770 | SREPB cleavage-activating protein |
| 322 | RPPsSEFLDL | 476 | 485 | L | Q9P2R6 | Arginine-glutamic acid dipeptide repeats protein |
| 323 | RPQRAtSNVF | 13 | 22 | L | P19105 | Myosin regulatory light chain 12A |
| 324 | RPQRATsNVF | 13 | 22 | L | P19105 | Myosin regulatory light chain 12A |
| 325 | RPRANsGGVDL | 1162 | 1172 | L | Q92766 | Ras-responsive element-binding protein 1 |
| 326 | RPRGsQSLL | 1040 | 1047 | M | P21860 | Receptor tyrosine-protein kinase erbB-3 |
| 327 | RPRPHsAPSL | 108 | 117 | L | Q5JXC2 | Migration and invasion-inhibitory protein |
| 328 | RPRPVsPSSL | 430 | 439 | L | P57059 | Serine/threonine-protein kinase SIK1 |
| 329 | RPRRsSTQL | 31 | 39 | M | A5D8T4 | TNFRSF8/Tumor necrosis factor receptor superfamily member 8 (CD30 antigen) |
| 330 | RPRsAVLL | 1873 | 1880 | L | Q12802 | A-kinase anchor protein 13 |
| 331 | RPRsLEVTI | 239 | 247 | L | O15553 | Pyrin |
| 332 | RPRSLsSPTVTL | 443 | 454 | M | Q96PU5 | E3 ubiquitin-protein ligase NEDD4-like |
| 333 | RPRsPAARL | 111 | 119 | L | Q9P2Y4 | Zinc finger protein 219 |
| 334 | RPRsPGSNSKV | 671 | 681 | L | P78347 | General transcription factor III |
| 335 | RPRsPPPRAP | 499 | 508 | M | O43900 | PRICKLE3/Prickle-like protein 3 |
| 336 | RPRsPRQNSI | 689 | 698 | L | Q99700 | Ataxin-2 |
| 337 | RPRsPSPIS | 1015 | 1023 | L | P41594 | Metabotropic glutamate receptor 5 |
| 338 | RPRsPTGP | 219 | 226 | L | Q96I25 | Splicing factor 45 |

TABLE 10-continued

Phosphopeptides Presented in Association with Class I and Class II
MHC Molecules on Cancer Cells: HLA-B*0702 Phosphopeptides on
Melanoma (M) and/or Leukemia (L)

| SEQ ID No. | Sequence | Start | Stop | L/M | UniProt | Source Protein |
|---|---|---|---|---|---|---|
| 339 | RPRsPTGPsNSF | 219 | 230 | L | Q96I25 | Splicing factor 45 |
| 340 | RPRPVsPSSL | 430 | 439 | L | P57059 | Serine/threonine protein kinase SIK1 |
| 341 | RPSGRREsL | 1757 | 1765 | M | Q14643 | ITPR1/Inositol 1,4,5-triphosphate receptor, type 1 |
| 342 | RPSRSsPGL | 859 | 867 | L | Q8N3V7 | Synaptopodin |
| 343 | RPSsLPDL | 661 | 668 | L | Q8NFD5 | AT-rich interactive domain-containing protein 1B |
| 344 | RPsSPALYF | 261 | 269 | L | Q9Y3Q8 | TSC22 domain family protein 4 |
| 345 | RPStPKSDSEL | 246 | 256 | L | Q14693 | Phosphatidate phosphatase LPIN1 |
| 346 | RPTsRLNRL | 860 | 868 | L | Q15788 | Nuclear receptor coactivator 1 |
| 347 | RPVsPFQEL | | | | | No database hit |
| 348 | RPVsPGKDI | 406 | 414 | L | P31629 | Transcription factor HIVEP2 |
| 349 | RPVtPVSDL | 63 | 71 | L | Q13118 | Krueppel-like factor 10 |
| 350 | RPWsPAVSA | 380 | 388 | L | P12755 | Ski oncogene |
| 351 | RPYsPPPFFSL | 187 | 196 | L | Q9NYF3 | Protein FAM53C |
| 352 | RRKsQVAEL | 244 | 252 | L | Q9BYG3 | MKI67 FHA domain-interacting nucleolar phosphoprotein |
| 353 | RRLsGPLHTL | 610 | 619 | M | Q86Y91 | Kinesin-like protein KIF18B |
| 354 | RRPsYTLGM | 1629 | 1637 | M | O43166 | Signal induced proliferation associated 1-like protein 1 |
| 355 | RRssFLQVF | 585 | 593 | M | Q15436 | Protein transport protein Sec23A |
| 356 | RRSsLDAEIDSL | 113 | 124 | L | Q93052 | Lipoma-preferred partner |
| 357 | RRsSQSWSL | 29 | 37 | M | Q9Y4E1 | Protein FAM21C |
| 358 | RSEsKDRKL | 196 | 204 | L | Q92551 | Inositol hexakisphosphate kinase 1 |
| 359 | RSGsLERKV | 1119 | 1127 | L | O94964 | Uncharacterized protein C20orf117 |
| 360 | RSLsPGGAA | 291 | 299 | L | Q96T37 | Putative RNA-binding protein 15 |
| 361 | RSLsPLLF | 3315 | 3322 | L | Q5THJ4 | Vacuolar protein sorting-associated protein 13D |
| 362 | RSRsPRPAL | | | M | | no data base hit |
| 363 | RTEsDSGLKK | 2495 | 2504 | L | Q12802 | A-kinase anchor protein 13 |
| 364 | RTFsPTYGL | 426 | 434 | M | O15061 | SYNM/Synemin/desmuslin |
| 365 | RTRsPSPTL | 515 | 523 | M | Q86UU1 | Pleckstrin homology-like domain family B |
| 366 | RVRsPTRSP | 158 | 166 | L | Q03164 | Histone-lysine N-methyltransferase MLL |
| 367 | SPAsPKISL | 493 | 501 | L | Q8WWM7 | Ataxin-2-like protein |
| 368 | SPEKAGRRsSL | 588 | 598 | L | A6NC98 | Coiled-coil domain-containing protein 88B |
| 369 | SPFKRQLsL | 288 | 296 | M | P49757 | NUMB/Numb protein homolog |
| 370 | SPGLARKRsL | 851 | 860 | L | Q9H2Y7 | Zinc finger protein 106 homolog |
| 371 | SPKsPGLKA | 105 | 113 | L | Q6JBY9 | CapZ-interacting protein |
| 372 | SPKsPTAAL | 425 | 433 | M | Q53EZ4 | Centrosomal protein of 55 kDa |
| 373 | SPRERsPAL | 243 | 251 | M | Q9Y2W1 | Thyroid hormone receptor associated protein 3 |
| 374 | SPRRsRSISL | 159 | 168 | L/M | Q16629 | Serine/Arginine-rich splicing factor 7 |

TABLE 10-continued

Phosphopeptides Presented in Association with Class I and Class II MHC Molecules on Cancer Cells: HLA-B*0702 Phosphopeptides on Melanoma (M) and/or Leukemia (L)

| SEQ ID No. | Sequence | Start | Stop | L/M | UniProt | Source Protein |
|---|---|---|---|---|---|---|
| 375 | SPRRsRSIsL | 159 | 168 | L/M | Q16629 | Serine/Arginine-rich splicing factor 7 |
| 376 | SPRsITSTP | 290 | 298 | M | Q9P0K7 | Ankycorbin/retinoic acid induced protein 14 |
| 377 | SPRsPGKPM | | | L | | No database hit |
| 378 | SPRsPGRSL | | | | | No data base hit |
| 379 | SPRsPSTTYL | 772 | 781 | L | Q13111 | Chromatin assembly factor 1 subunit A |
| 380 | SPRTPVsPVKF | 441 | 451 | M | P23443 | Ribosomal protein S6 kinase beta-1 |
| 381 | SPRtPVsPVKF | 441 | 451 | M | P23443 | Ribosomal protein S6 kinase beta-1 |
| 382 | SPSsPSVRRQL | 1988 | 1998 | L | O75179 | Ankyrin repeat domain-containing protein 17 |
| 383 | SPSTSRSGGsSRL | 18 | 30 | L | Q9BUV0 | UPF0471 protein C1orf63 |
| 384 | SPVVHQsL | 614 | 621 | M | Q15678 | Tyrosine-protein phosphatase non-receptor type 14 |
| 385 | TPAQPQRRsL | 113 | 122 | L | Q9ULW0 | Targeting protein for Xklp2 |
| 386 | TPIsPGRASGM | 273 | 283 | L | Q01196 | Runt-related transcription factor 1 |
| 387 | TPRsPPLGL | 755 | 763 | L | Q16584 | Mitogen-activated protein kinase kinase kinase 11 |
| 388 | TPRsPPLGLI | 755 | 764 | L | Q16584 | Mitogen-activated protein kinase kinase kinase 11 |
| 389 | VPRsPKHAHSSSL | 242 | 254 | L | O95425 | Supervillin |
| 390 | YPSsPRKL | | | M | | No data base hit |
| 391 | YQRsFDEVEGV | 136 | 146 | L | Q6Y7W6 | PERQ amino acid-rich with GYF domain-containing protein 2 |
| 392 | YQRsFDEVEGVF | 136 | 147 | L | Q6Y7W6 | PERQ amino acid-rich with GYF domain-containing protein 2 |

Column 2: Phosphopeptide sequences; pSer, pThr and pTyr are specified by s, t, and y, respectively.
Column 3 & 4: Entries define the location of the phosphopeptides within the sequence of the parent protein.
Column 5: Melanoma and Leukemia are specified by M and L, respectively.
Column 6: Protein identifier in the UniProt database, www[dot]uniprot[dot]org
Column 7: Name of the protein in the UniProt database.

TABLE 11

HLA-A*0201 Phosphopeptides on Melanoma

| SEQ ID No. | Sequence | Start | Stop | UniProt | Source Protein |
|---|---|---|---|---|---|
| 393 | ALYsPAQPSL | 301 | 310 | Q9NXE4 | SMPD4/Sphingomyelin phopshodiesterase 4 |
| 394 | AMAAsPHAV | 64 | 72 | Q13151 | Heterogeneous nuclear ribonucleoprotein A0 (HNRNPA0) |
| 395 | AVVsPPALHNA | 855 | 865 | O60885 | bromodomain-containing protein-4 (BRD4) |
| 396 | GLLGsPVRA | 38 | 46 | P30305 | M-phase inducer phosphatase 2 (CDC25B) |
| 397 | ILKsPEIQRA | 292 | 301 | P36578 | 60S ribosomal protein L4 (RPL4) |
| 398 | IMDRtPEKL | 126 | 134 | O75815 | Breast cancer anti-estrogen resistance 3 (BCAR3) |
| 399 | KLAsPELERL | 97 | 106 | P17535 | Transcription factor jun-D (JUND) {70-79/P05412/ Transcription factor AP-1/JUN} |
| 400 | KLFPDtPLAL | 587 | 596 | Q12906 | Interleukin enhancer-binding factor 3 (ILF3) |
| 401 | KLIDIVsSQKV | 461 | 471 | O14757 | Serine/threonine-protein kinase Chk1 (CHEK1) |
| 402 | KLLDFGSLsNLQV | 107 | 119 | P08708 | 40S ribosomal protein S17 (RPS17) |
| 403 | KLLsPSNEKL | 544 | 553 | Q14694 | Ubiquitin carboxyl-terminal hydrolase 10 (USP10) |

TABLE 11-continued

HLA-A*0201 Phosphopeptides on Melanoma

| SEQ ID No. | Sequence | Start | Stop | UniProt | Source Protein |
|---|---|---|---|---|---|
| 404 | KLLSSAQRtL | 29 | 38 | Q14929 | Zinc finger protein 169 (ZNF169) |
| 405 | KLMsPKADVKL | 44 | 54 | Q86T90 | Uncharacterized protein KIAA1328 (KIAA1328) |
| 406 | KVQVtSLSV | 3 | 10 | Q8TE06 | SLTPO04 (predicted) |
| 407 | LMFsPVTSL | 887 | 895 | Q9C0A6 | SET domain-containing protein 5 (SETD5) |
| 408 | RLDsYVRSL | 129 | 137 | Q9Y5R8 | Trafficking protein particle complex subunit 1 (TRAPPC1) |
| 409 | RLFsKELRC | 30 | 38 | Q15543 | Transcription iniation factor TFIID subunit 13 (TAF13) |
| 410 | RLLsPLSSA | 581 | 589 | Q8IY672 | Ribonucleoprotein PTB-binding 1 (RAVER1) |
| 411 | RLQsTSERL | 217 | 225 | Q96TA2 | ATP-dependent zinc metalloprotease YME1L1 (YME1L1) |
| 412 | RLSsPLHFV | 400 | 408 | Q8NC44 | Protein FAM134A (FAM134A) |
| 413 | RQDsTPGKVFL | 61 | 71 | P13056 | Nuclear receptor subfamily 2 group C member 1 (NR2C1) |
| 414 | RQIsQDVKL | 165 | 173 | Q01433 | AMP deaminase 2 (AMPD2) |
| 415 | RQLsSGVSEI | 79 | 88 | P04792 | Heat shock protein beta 1 (HSPB1) |
| 416 | RTFsPTYGL | 426 | 434 | O15061 | Synemin (SYNM), Desmuslin |
| 417 | RTLsHISEA | 450 | 458 | Q6ZS17 | Protein FAM65A (FAM65A) |
| 418 | RVAsPTSGV | 1097 | 1105 | Q9Y4H2 | Insulin receptor substrate 2 (IRS2) |
| 419 | SLLTsPPKA | 938 | 946 | Q14669 | Probable E3 ubiquitin-protein ligase TRIP12 (TRIP12) |
| 420 | SLQPRSHsV | 448 | 456 | Q9Y2H5 | Pleckstrin homology domain-containing family A member 6 (PLEKHA6) |
| 421 | SMtRSPPRV | 248 | 256 | Q9BRL6 | Serine/arginine-rich splicing factor 8 (SRSF8) |
| 422 | TLAsPSVFKST | 38 | 48 | Q6PGQ7 | Protein aurora borealis (BORA) |
| 423 | VLKGsRSSEL | 38 | 47 | Q96B45 | UPF0693/C10orf32 |
| 424 | VLLsPVPEL | 552 | 560 | Q9H1A4 | Anaphase-promoting complex subunit 1 (ANAPC1) |
| 425 | VMFRtPLASV | 319 | 328 | Q9UKT4 | F-box only protein 5 (FBXO5) |
| 426 | VMIGsPKKV | 1437 | 1445 | Q68CZ2 | Tensin-3 (TNS3) |
| 427 | YLDsGIHSGA | 30 | 39 | P35222 | Catenin beta-1 (CTNNB1) |

TABLE 12

HLA-A*0201 Phosphopeptides on Leukemia or Transformed B Cell

| SEQ ID NO. | Sequence | Start | Stop | UniProt | Source Protein |
|---|---|---|---|---|---|
| 428 | ALDsGASLLHL | 482 | 492 | P57078 | Receptor-interacting serine/threonine-protein kinase 4 |
| 429 | ALGsRESLATI | 225 | 235 | Q86YV0 | RAS Protein activator like-3 |
| 430 | AMLGSKsPDPYRL | 904 | 916 | P18583 | Protein SON |
| 431 | AVIHQsLGL | 251 | 259 | Q9BV87 | Protein CNPPD1 |
| 432 | DSsEEKFL | 20 | 27 | P02808 | Statherin (saliva) |
| 433 | GGSFGGRSSGsP | 348 | 359 | P51991 | Heterogeneous nuclear ribonucleoprotein A3, HNRNPA3 |
| 434 | GLLsPARLYAI | 355 | 365 | P42704 | Leucine rich PPR-motif containing protein mito. precursor |
| 435 | ILDsGIYRI | 51 | 59 | Q9UPZ3 | Hermansky-Pudlak syndrome 5 protein |
| 436 | KAKsPAPGL | 2421 | 2429 | Q9Y618 | Nuclear receptor corepressor 2 |

TABLE 12-continued

HLA-A*0201 Phosphopeptides on Leukemia or Transformed B Cell

| SEQ ID NO. | Sequence | Start | Stop | UniProt | Source Protein |
|---|---|---|---|---|---|
| 437 | KIFsGVFVKV | 114 | 123 | Q6DKI1 | 60S ribosomal protein L7-like 1 |
| 438 | KLDsPRVTV | 215 | 220 | Q96G04 | Protein FAM86A |
| 439 | KLFsPSKEAEL | 844 | 854 | Q96RY5 | Protein cramped-like |
| 440 | KLIDRTEsL | 197 | 205 | P33241 | Lymphocyte-specific protein 1 |
| 441 | KLLQFYPsL | 77 | 85 | Q9GZY6 | Linker for activation of T-cells family member 2 |
| 442 | KLMAPDIsL | 52 | 60 | Q12982 | BCL2/adenovirus E1B 19 kDa protein-interacting protein 2 |
| 443 | KLMsPKADVKL | 44 | 54 | Q86T90 | Uncharacterized protein KIAA1328 |
| 444 | KMDsFLDMQL | 129 | 138 | Q86UW6 | NEDD4-binding protein 2 |
| 445 | KMYsEIDIKV | 646 | 655 | Q15029 | 116 Kda U5 small nuclear ribonucleoprotein component |
| 446 | KVAsLLHQV | 330 | 338 | Q8NFZ5 | TNFAIP3-interacting protein 2 |
| 447 | KVLsTEEMEL | 31 | 40 | Q6NZ67 | Protein FAM128B |
| 448 | MLAEsPSVPRL | 27 | 37 | Q8WUC7 | Putative uncharacterized protein |
| 449 | RLAsLNAEAL | 118 | 127 | Q8TBE0 | Bromo adjacent homology domain-containing 1 protein |
| 450 | RPR(sLss)PTVTL# | 443 | 454 | Q96PU5 | E3 ubiquitin-protein ligase NEDD4-like |
| 451 | RQAsIELPSM | 249 | 258 | P33241 | Lymphocyte-specific protein 1 |
| 452 | RQAsIELPSMAV | 249 | 260 | P33242 | Lymphocyte-specific protein 1 |
| 453 | RQAsLSISV | 11 | 19 | A0JLT6 | Protein kinase 2D |
| 454 | RQIsFKAEV | 181 | 189 | Q9Y385 | Ubiquitin-conjugating enzyme E2 J1 |
| 455 | RQIsQDVKL | 165 | 174 | Q01433 | AMP deaminase 2 |
| 456 | RQLsSGVSEI | 80 | 89 | P04792 | HSPB1, heat shock protein beta 1 |
| 457 | RTFsPTYGL | 426 | 434 | O15061 | SYNM, Desmuslin |
| 458 | RTYsGPMNKV | 53 | 64 | Q8WVV4 | POF1B, Premature ovarian failure protein, 1B |
| 459 | RVAsPTSGV | 1097 | 1105 | Q9Y4H2 | Insulin Receptor Substrate 2 (IRS-2) |
| 460 | SMTRsPPRV | 248 | 256 | Q9BRL6 | SFRS8, Serine/arginine-rich splicing factor 8 |
| 461 | SMtRSPPRV | 248 | 256 | Q9BRL6 | SFRS8, Serine/arginine-rich splicing factor 8 |
| 462 | VLLsPVPEL | 551 | 559 | Q9H1A4 | Anahase promoting complex subunit 1 |
| 463 | VLMK(sPs)PAL## | 1117 | 1126 | Q9H6S0 | YTHDC2, Probable ATP-dependent RNA helicase |
| 464 | VMIGsPKKV | 1437 | 1445 | Q68CZ2 | Tensin-3 (TNS3) |
| 465 | YQLsPTKLPSI | 429 | 439 | O60934 | Nibrin/cell cycle regulatory protein p95 |

(sLss) indicates that one of these particular serines is phosphorylated.
(sPs) indicates that one of these particular serines is phosphorylated.
Column 2: Phosphopeptide sequences; pSer, pThr and pTyr are specified by s, t, and y, respectively.
Column 3 & 4: Entries define the location of the phosphopeptides within the sequence of the parent protein.
Column 5: Protein identifier in the UniProt database, www[dot]uniprot[dot]org
Column 6: Name of the protein in the UniProt database.

TABLE 13

Class II MHC Phosphopeptides (DRB1*0404, 0101 or DRB4*0103) on
Melanoma (M) and/or Transformed B-Cells (B)

| SEQ ID NO. | Sequence | Start | Stop | M/B | UniProt | Source Protein |
|---|---|---|---|---|---|---|
| 466 | EPAsPAAsISRLsGEQVDGKG | 617 | 637 | M/B | O60353 | Frizzled-6 |
| 467 | SPAASISRLsGEQVDGKG | 620 | 637 | | | |
| 468 | ASISRLsGEQVDGKG | 623 | 637 | | | |
| 469 | AsISRLSGEQVDGKG | 623 | 637 | | | |
| 470 | AsISRLSGEQVDGKG | 623 | 637 | | | |
| 471 | AsIsRLSGEQVDGKGQ | 623 | 638 | | | |
| 472 | APSTYAHLsPAK | 324 | 335 | M/B | Q86X29 | Lipolysis-stimulated lipoprotein receptor |
| 473 | APSTYAHLsPAKTPPPP | 324 | 340 | | | |
| 474 | KYsPGKLRGN | 142 | 151 | M | P84157 | Matrix-remodeling-associated protein 7 |
| 475 | APPAYEKLsAEQ | 100 | 111 | M | Q16655 | Melanoma antigen recognized by T-cells/MART-1 |
| 476 | APPAYEKLsAEQSPP | 100 | 114 | | | |
| 477 | APPAYEKLsAEQSPPP | 100 | 115 | | | |
| 478 | APPAYEKLsAEQSPPPY | 100 | 116 | | | |
| 479 | sGGDDDWTHLSSKEVDPST | 332 | 350 | M/B | Q13501 | Sequestosome-1 |
| 480 | sGGDDDWTHLSSKEVDPSTG | 332 | 351 | | | |
| 481 | sGGDDDWTHLsSKEVDPSTGE | 332 | 352 | | | |
| 482 | sGGDDDWTHLsSKEVDPSTGEL | 332 | 353 | | | |
| 483 | sGGDDDWTHLsSKEVDPSTGELQ | 332 | 354 | | | |
| 484 | GGDDDWTHLsSKEVDPS | 333 | 349 | | | |
| 485 | GGDDDWTHLsSKEVDPSTG | 333 | 351 | | | |
| 486 | GDDDWTHLsSKEVD | 334 | 347 | | | |
| 487 | GDDDWTHLsSKEVDP | 334 | 348 | | | |
| 488 | GDDDWTHLsSKEVDPS | 334 | 349 | | | |
| 489 | GDDDWTHLsSKEVDPST | 334 | 350 | | | |
| 490 | GDDDWTHLsSKEVDPSTG | 334 | 351 | | | |
| 491 | DDDWTHLsSKEVDP | 335 | 349 | | | |
| 492 | DDDWTHLsSKEVDPST | 335 | 351 | | | |
| 493 | DDWTHLsSKEVDPS | 336 | 349 | | | |
| 494 | DWTHLsSKEVDPS | 337 | 349 | | | |
| 495 | DWTHLsSKEVDPSTG | 337 | 351 | | | |
| 496 | WTHLsSKEVDPS | 338 | 349 | | | |
| 497 | WTHLsSKEVDPSTG | 338 | 351 | | | |
| 498 | FVSKVMIGsPKKV | 1333 | 1445 | M | Q68CZ2 | Tensin-3 |
| 499 | VSKVMIGsPKKV | 1434 | 1445 | | | |
| 500 | VMIGsPKKV | 1437 | 1445 | | | |
| 501 | SKEDKNGHDGDTHQEDDGEKsD | 176 | 197 | M | Q08117 | Amino-terminal enhancer of split |
| 502 | SGGAQsPLRYLHVL | 58 | 72 | M | Q6NXT1 | Ankyrin repeat domain-containing protein 54 |

TABLE 13-continued

Class II MHC Phosphopeptides (DRB1*0404, 0101 or DRB4*0103) on Melanoma (M) and/or Transformed B-Cells (B)

| SEQ ID NO. | Sequence | Start | Stop | M/B | UniProt | Source Protein |
|---|---|---|---|---|---|---|
| 503 | GSALGGGGAGLSGRASGGAQsPLRYLHV | 43 | 71 | | | |
| 504 | LGGGGAGLSGRASGGAQsPLRYLHV | 46 | 71 | | | |
| 505 | GsPTMVEKGLEPGVFTL | 640 | 656 | M | Q9HCE9 | Anoctamin-8 |
| 506 | EGsPTMVEKGLEPGVFTL | 639 | 656 | | | |
| 507 | EEGsPTMVEKGLEPGVFTL | 638 | 656 | | | |
| 508 | EEMPENALPsDEDDKDPNDPYRAL | 779 | 802 | M | O14617 | AP-3 complex subunit delta-1 |
| 509 | SNFKsPVKTIR | 205 | 215 | M | P67870 | Casein kinase II subunit beta |
| 510 | AASNFKsPVKTIR | 203 | 215 | | | |
| 511 | QAASNFKsPVKTIR | 202 | 215 | | | |
| 512 | FKsPVKTIR | 207 | 215 | | | |
| 513 | NFKsPVKTIR | 206 | 215 | | | |
| 514 | SSsPTHAKSAHV | 196 | 207 | M | O75508 | Claudin-11 |
| 515 | YYTAGSSsPTHAKSAHV | 191 | 207 | | | |
| 516 | RSYsPDHRQK | 122 | 131 | M/B | Q14241 | Elongin A, Transcriptioni elongation factor B |
| 517 | VRQsVTSFPDADAFHHQ | 117 | 133 | M | P50402 | Emerin |
| 518 | FDKHTLGDsDNES | 171 | 183 | M/B | P02794 | Ferritin heavy chain |
| 519 | FKMPQEKsPGYS | 471 | 482 | M | Q9H3M3 | FLJ20689 |
| 520 | TKsVKALSSLHGDD | 2393 | 2406 | M/B | P11717 | Insulin like growth factor 2 receptor |
| 521 | TKsVKALSSLHGDDQD | 2393 | 2408 | | | |
| 522 | TTKsVKALSSLHG | 2392 | 2404 | | | |
| 523 | TTKsVKALSSLHGDD | 2392 | 2406 | | | |
| 524 | TTKsVKALSSLHGDDQ | 2392 | 2407 | | | |
| 525 | TTKsVKALSSLHGDDQD | 2392 | 2408 | | | |
| 526 | TTKsVKALSSLHGDDQDS | 2392 | 2409 | | | |
| 527 | TKsVKALSSLHGDDQ | 2393 | 2407 | | | |
| 528 | KsVKALSSLHGDDQ | 2394 | 2407 | | | |
| 529 | KsVKALSSLHGDDQD | 2394 | 2408 | | | |
| 530 | TTKSVKALSSLHGDDQDsED | 2392 | 2411 | | | |
| 531 | TTKSVKALSSLHGDDQDsEDE | 2392 | 2412 | | | |
| 532 | KSVKALSSLHGDDQDsEDE | 2394 | 2412 | | | |
| 533 | KLVSFHDDsDEDL | 2476 | 2488 | | | |
| 534 | RVAsPTSGVKR | 1097 | 1107 | M | Q9Y4H2 | Insulin receptor substrate 2 |
| 535 | VAMPVKKSPRRSsSDEQGLSYSSLKNV | 544 | 570 | M | Q9NPH3 | Interleukin 1 receptor accessory protein |
| 536 | QVAMPVKKSPRRSsSDEQGLSYSSLKNV | 543 | 570 | | | |
| 537 | SSNGKMASRRsEEKEAGEI | 353 | 371 | M | Q53G47 | LUC-like isoform B |
| 538 | SSNGKMASRRsEEKEAG | 353 | 369 | | | |

TABLE 13-continued

Class II MHC Phosphopeptides (DRB1*0404, 0101 or DRB4*0103) on Melanoma (M) and/or Transformed B-Cells (B)

| SEQ ID NO. | Sequence | Start | Stop | M/B | UniProt | Source Protein |
|---|---|---|---|---|---|---|
| 539 | EGEEPTVYsDEEEPKDESARKND | 173 | 195 | M | O00264 | Membrane-associated progesterone receptor component 1 |
| 540 | KEGEEPTVYsDEEEPKDESARKND | 172 | 195 | | | |
| 541 | ASKMTQPQSKSAFPLSRKNKGsGsLDG | 165 | 191 | M | Q9NYR9 | NF-kappa-B inhibitor-interacting Ras-like |
| 542 | NRAMRRVsSVPSR | 206 | 218 | M/B | Q99569 | Plakophillin-4 |
| 543 | NRAMRRVsSVPSRAQ | 206 | 220 | | | |
| 544 | RPAsPtAIRRIGSVTSRQT | 278 | 296 | | | |
| 545 | APPPLVPAPRPSsPPRGPGPARADR | 348 | 372 | M | Q9HAH7 | Probable fibrosin-1 long transcript protein |
| 546 | TIGEKKEPsDKSVDS | 424 | 438 | M | Q9NVA4 | Transmembrane protein 184C/TMEM 34 |
| 547 | ERsPLLSQETAGQKP | 5 | 19 | M | Q9H1Z9 | Tetraspanin-10/Occulospanin |
| 548 | ERsPLLSQETAGQKPL | 5 | 20 | | | |
| 549 | GERsPLLSQETAGQKP | 4 | 19 | | | |
| 550 | GERsPLLSQETAGQKPL | 4 | 20 | | | |
| 551 | VLKSRKssVTEE | 783 | 794 | M/B | O94874 | UPF0555 protein KIAA0776 |
| 552 | sSPPFPVPVYTRQAPKQVIK | 758 | 776 | B | P78235 | ADAM 8 |
| 553 | RRIDIsPSTLR | 653 | 663 | B | A2RU75 | BCL2-associated transcriptioin factor 1 |
| 554 | RRIDIsPSTLRK | 653 | 664 | | | |
| 555 | DPTRRFFKVtPPPGSGPQ | 328 | 345 | B | P15391 | B-Lymphocyte antigen CD19 |
| 556 | SGPKPLFRRMsSLVGPTQ | 25 | 42 | B | P11836 | B-Lymphocyte antigen CD20 |
| 557 | GPKPLFRRMsS | 26 | 36 | | | |
| 558 | GPKPLFRRMsSL | 26 | 37 | | | |
| 559 | GPKPLFRRMsSLV | 26 | 38 | | | |
| 560 | GPKPLFRRMsSLVG | 26 | 39 | | | |
| 561 | GPKPLFRRMsSLVGP | 26 | 40 | | | |
| 562 | GPKPLFRRMsSLVGPT | 26 | 41 | | | |
| 563 | GPKPLFRRMsSLVGPTQ | 26 | 42 | | | |
| 564 | GPKPLFRRMsSLVGPTQS | 26 | 43 | | | |
| 565 | RAKsPISLK | 509 | 517 | B | Q9BXL7 | Caspase recruitment domain-containing protein 11 |
| 566 | ESsVRSQEDQLSR | 49 | 61 | B | Q9HD44 | Chromatin-modifying protein 1a |
| 567 | ESsVRSQEDQLSRR | 49 | 62 | | | |
| 568 | RsPEDEYELLMPHRISSH | 142 | 159 | B | Q8N6F7 | Germinal center B-cell-expressed transcript 2 protein |
| 569 | sPEDEYELLMPHRISSH | 143 | 159 | | | |
| 570 | SPEDEYELLMPHRIsSH | 143 | 159 | | | |
| 571 | ELLMPHRIsSHF | 149 | 160 | | | |
| 572 | ELLMPHRIsSHFL | 149 | 161 | | | |
| 573 | TPDPSKFFSQLsSEHGGDV | 282 | 300 | B | P14784 | Interleukin-2 receptor subunit beta |

TABLE 13-continued

Class II MHC Phosphopeptides (DRB1*0404, 0101 or DRB4*0103) on Melanoma (M) and/or Transformed B-Cells (B)

| SEQ ID NO. | Sequence | Start | Stop | M/B | UniProt | Source Protein |
|---|---|---|---|---|---|---|
| 574 | tPDPSKFFSQLSSEHGGDVQ | 282 | 301 | | | |
| 575 | DKLsVIAEDSESGKQ | 293 | 307 | B | Q08334 | Interleukin-10 receptor beta chain |
| 576 | DKLsVIAEDSESGKQN | 293 | 308 | | | |
| 577 | DKLsVIAEDSESGKQNP | 293 | 309 | | | |
| 578 | DKLsVIAEDSESGKQNPG | 293 | 310 | | | |
| 579 | DKLsVIAEDSESGKQNPGDS | 293 | 312 | | | |
| 580 | KLsVIAEDSESGKQN | 294 | 308 | | | |
| 581 | KLsVIAEDSESGKQNP | 294 | 309 | | | |
| 582 | KLsVIAEDSESGKQNPG | 294 | 310 | | | |
| 583 | AsPTIEAQGTSPAHDN | 130 | 145 | B | Q12912 | Lymphoid restricted membrane protein |
| 584 | AsPTIEAQGTSPAHDNI | 130 | 146 | | | |
| 585 | AsPTIEAQGTSPAHDNIA | 130 | 147 | | | |
| 586 | SSsWRILGSKQSEHRP | 346 | 361 | | | |
| 587 | NLELSKFRMPQPSSGREsPRH | 88 | 108 | B | P56181 | NADH-ubiquinone oxidoreductase flavoprotein 3 |
| 588 | LSKFRMPQPSSGREsPRH | 91 | 108 | | | |
| 589 | sDFHAERAAREK | 473 | 484 | B | Q96CV9 | Optineurin |
| 590 | sPERPFLAILGGAKVADK | 203 | 220 | B | P00668 | Phosphoglycerate kinase 1 |
| 591 | sPERPFLAILGGAKVADKIQ | 203 | 222 | | | |
| 592 | PPLPEDSIKVIRNMRAAsPPA | 318 | 338 | B | Q5VYV7 | Protein FAM40A |
| 593 | RTMsEAALVRK | 140 | 150 | B | Q6ZTQ3 | Ras association domain-containing protein 6 |
| 594 | MPRPsIKKAQNSQAARQ | 80 | 96 | B | Q8N5H7 | SH2 Domain containing 3C isoform 1 |
| 595 | TKDKYMASRGQKAKsMEG | 1050 | 1067 | B | Q9UHW9 | Solute carrier family 12, member 6, isoform a |
| 596 | THKGEIRGASTPFQFRAssP | 106 | 125 | B | Q86VP1 | Tax1-binding protein 1, isoform 1 or 2 |
| 597 | HKGEIRGASTPFQFRAssP | 107 | 125 | | | |
| 598 | VPHHGFEDWsQIR | 559 | 571 | B | Q15025 | TNFAIP3-interacting protein 1 |
| 599 | KIEKIyIMKADTVIVG | 50 | 65 | B | P28908 | Tumor necrosis factor receptor superfamily member 8 |
| 600 | IEKIyIMKADTVIVG | 51 | 65 | | | |
| 601 | STIQNsPTKK | 391 | 400 | B | Q5VYV7 | UPF0492 protein C20orf94 |
| 602 | GtLRRSDSQQAVK | 402 | 414 | M/B | Q15036 | Sorting nexin-17 |
| 603 | GtLRRSDSQQAVKS | 402 | 415 | | | |
| 604 | GtLRRSDSQQAVKSPP | 402 | 417 | | | |
| 605 | EESsDDGKKY | 136 | 145 | B | Q9P2B7 | UPF0501 protein KIAA1430 |
| 606 | KNRsWKYN | 657 | 664 | B | Q9UBH6 | Xenotropic and polytropic retrovirus receptor 1 |
| 607 | KNRsWKYNQ | 657 | 665 | | | |
| 608 | KNRsWKYNQSISLR | 657 | 670 | | | |
| 609 | KNRsWKYNQSISLRRP | 657 | 672 | | | |

TABLE 13-continued

Class II MHC Phosphopeptides (DRB1*0404, 0101 or DRB4*0103) on
Melanoma (M) and/or Transformed B-Cells (B)

| SEQ ID NO. | Sequence | Start | Stop | M/B | UniProt | Source Protein |
|---|---|---|---|---|---|---|
| 610 | NRsWKYNQSISLR | 658 | 670 | | | |
| 611 | NRsWKYNQSISLRRP | 658 | 672 | | | |
| 612 | RsWKYNQSISLRRP | 659 | 672 | | | |

Column 2: Phosphopeptide sequences; pSer, pThr and pTyr are specified by s, t, and y, respectively.
Column 3 & 4: Entries define the location of the phosphopeptides within the sequence of the parent protein.
Column 5: Melanoma and transformed B cells are specified by M and B, respectively.
Column 6: Protein identifier in the UniProt database, www[dot]uniprot[dot]org
Column 7: Name of the protein in the UniProt database.

TABLE 14

Peptides Selected for Immunotherapy of Melanoma

| SEQ ID NO. | Sequence | Start | Stop | Uniprot | Source Protein |
|---|---|---|---|---|---|
| | | | | | HLA A*0201 |
| 396 | GLLGsPVRA | 38 | 46 | P30305 | M-phase inducer phosphatase 2 (CDC25B) |
| 398 | IMDRtPEKL | 126 | 134 | O75815 | Breast cancer anti-estrogen resistance 3 (BCAR3) |
| 418 | RVAsPTSGV | 1097 | 1105 | Q9Y4H2 | Insulin receptor substrate 2 (IRS2) |
| 2080 | YLDsGIHSGV | 30 | 39 | P35222 | Catenin beta-1 (CTNNB1) (A9V substitution)) |
| 426 | VMIGsPKKV | 1437 | 1445 | Q68CZ2 | Tensin-3 (TNS3) |
| | | | | | HLA A*0101 |
| 91 | IIEtPHKEI | 71 | 79 | O96020 | G1/S-specific cyclin-E2 |
| 93 | ISSsMHSLY | 222 | 230 | P50616 | Protein Tob1 |
| 97 | KSEsRQERY | 146 | 154 | Q05682 | Caldesmon |
| 98 | LLDPSRSYsY | 643 | 652 | Q9H706 | Protein FAM59A |
| 108 | RSIsVGENL | 1260 | 1268 | O60336 | Mitogen-activated protein kinase-binding protein 1 |
| 109 | RTEPSKsPGSLRY | 695 | 707 | Q9UGU0 | Transcription factor 20 |
| 110 | SIDsPQKL | 724 | 731 | Q12888 | Tumor suppressor p53-binding protein 1 |
| 113 | SSDPASQLsY | 581 | 590 | Q08050 | Foxhead box protein M1 |
| 115 | STDsETLRY | 281 | 289 | Q9HCH5 | Synaptotagmin-like protein 2 |
| 117 | TMAsPGKDNY | 3 | 12 | O60684 | Importin subunit alpha-7 |
| | | | | | HLA A*0301 |
| 9 | KGIsSSSLKEK | 616 | 626 | P31629 | Transcription factor HIVEP2 |
| 14 | KLFsPAHKK | 458 | 466 | Q8TAT5 | Endonuclease VIII-like 3 |
| 22 | KSKtPLVAR | 1137 | 1145 | P28290 | Sperm-specific antigen 2 |
| 33 | RAFsFSKTPK | 808 | 817 | Q9H8V3 | Protein ECT2 |
| 51 | RSMsMPVAH | 429 | 437 | Q9Y4H2 | Insulin receptor substrate 2, IRS-2 |
| 52 | RSRRsPLLK | 874 | 882 | O95235 | Kinesin-like protein KIF20A |
| 60 | RSYsPRNSR | 140 | 148 | O75494 | Splicing factor, R/S-rich 13A |

TABLE 14-continued

Peptides Selected for Immunotherapy of Melanoma

| SEQ ID NO. | Sequence | Start | Stop | Uniprot | Source Protein |
|---|---|---|---|---|---|
| 65 | RVAsPTSGVK | 1097 | 1106 | Q9Y4H2 | Insulin receptor substrate 2 |
| 67 | RVKLPsGSKK | 147 | 156 | P62917 | 60S Ribosomal protein L8 |
| HLA B*0702 | | | | | |
| 266 | APRKGsFSALM | 5 | 14 | Q13619 | Cullin-4A |
| 267 | APRRYsSSL | 697 | 705 | Q68EM7 | Rho GTPase-activating protein 17 |
| 279 | HPRsPTPTL | 341 | 349 | Q96HE9 | Proline rich protein 11 |
| 281 | KARsPGRAL | 6 | 14 | Q14767 | Latent transforming growth factor-beta-binding protein-2 |
| 292 | KPRsPPRAL | 249 | 257 | Q86TG8 | Retrotransposon-derived protein PEG11 |
| 293 | KPRsPPRALV | 249 | 258 | Q86TG8 | Retrotransposon-derived protein PEG11 |
| 295 | KPRsPVVEL | 667 | 675 | P25098 | Beta-Adrenergic receptor kinase 1 |
| 299 | LPKsPPYTAF | 90 | 99 | P23588 | Eukaryotic translation initiation factor 4B |
| 369 | SPFKRQLsL | 288 | 296 | P49757 | NUMB/Numb protein homolog |
| 372 | SPKsPTAAL | 425 | 433 | Q53EZ4 | Centrosomal protein of 55 kDa |
| 375 | SPRRsRSIsL | 159 | 168 | Q16629 | Serine/Arginine-rich splicing factor 7 |
| 376 | SPRsITSTP | 290 | 298 | Q9P0K7 | Ankycorbin/retinoic acid induced protein 14 |
| HLA B*4402 | | | | | |
| 120 | AEEEIGtPRKF | 326 | 336 | P28749 | Retinoblastoma-like protein 1 |
| 122 | AESsPTAGKKL | 799 | 809 | Q8IWB9 | Testis-expressed sequence 2 protein |
| 123 | AtAGPRLGW | 621 | 629 | Q86W92 | Liprin-beta-1 |
| 124 | DERLRINsL | 49 | 57 | O60783 | 28S Ribosomal protein S14, mitochondrial |
| 128 | EEsSDDGKKY | 136 | 145 | Q9P2B7 | UPF0501 protein KIAA1430 |
| 132 | SEGsLHRKY | 81 | 89 | Q9ULM0 | Pleckstrin homology domain-containing family H, #1 |
| HLA B*2705 | | | | | |
| 136 | GRLGsPHRR | 109 | 117 | Q6UUV9 | CREB-regulated transcription coactivator 1 |
| 140 | HRLsPVKGEF | 367 | 376 | Q9Y2L9 | Leucine-rich repeat and calponin homology domain-containing protein 1 |
| 156 | RRFsRSPIR | 2026 | 2034 | P18583 | Protein SON |
| 158 | RRFsRSPIRR | 2026 | 2035 | P18583 | Protein SON |
| 177 | RRSsIGLRV | 136 | 144 | Q96GN5 | Cell division cycle-associated 7-like protein |
| 183 | RRVVQRSsL | 1139 | 1147 | Q04637 | Eukaryotic translation initiation factor 4 gamma 1 |
| 189 | SRsSRSPYSR | 168 | 177 | Q9BRL6 | Splicing factor, R/S-rich 2B |
| Class II MHC Molecules (DRB1*0404, 0101 or DRB4*0103) | | | | | |
| 477 | APPAYEKLsAEQSPPP | 100 | 115 | Q16655 | Melanoma antigen recognized by T-cells/MART-1 |
| 499 | VSKVMIGsPKKV | 1434 | 1445 | Q68CZ2 | Tensin-3 (TNS3) |

Column 2: Phosphopeptide sequences; pSer, pThr and pTyr are specified by s, t, and y, respectively.
Column 3 & 4: Entries define the location of the phosphopeptides within the sequence of the parent protein.
Column 5: Protein identifier in the UniProt database, www[dot]uniprot[dot]org
Column 6: Name of the protein in the UniProt database.

TABLE 15

Peptides Selected for Immunotherapy of Leukemia

| SEQ ID No. | Sequence | Start | Stop | UniProt | Source Protein |
|---|---|---|---|---|---|
| HLA A*0201 | | | | | |
| 440 | KLIDRTEsL | 197 | 205 | P33241 | Lymphocyte-specific protein 1 |
| 451 | RQAsIELPSM | 249 | 258 | P33241 | Lymphocyte-specific protein 1 |
| 452 | RQAsIELPSMAV | 249 | 260 | P33242 | Lymphocyte-specific protein 1 |
| 457 | RTFsPTYGL | 426 | 434 | O15061 | SYNM, Desmuslin |
| 460 | SMTRsPPRV | 248 | 256 | Q9BRL6 | SFRS8, Serine/arginine-rich splicing factor 8 |
| 464 | VMIGsPKKV | 1437 | 1445 | Q68CZ2 | Tensin-3 (TNS3) |
| 465 | YQLsPTKLPSI | 429 | 439 | O60934 | Nibrin/cell cycle regulatory protein p95 |
| HLA A*0101 | | | | | |
| 94 | ITQGtLKY | 1459 | 1467 | Q9Y618 | Nuclear receptor corepressor 2 |
| 102 | NTDsPLRY | 149 | 156 | P08865 | 40S Ribosomal protein SA |
| 103 | QLDsPQRALY | 59 | 68 | Q16587 | Zinc finger protein 74 |
| 104 | RGDsPKIDL | 433 | 441 | Q96B97 | SH3 domain-containing kinase-binding protein 1 |
| HLA A*0301 | | | | | |
| 17 | KMPTtPVKAK | 47 | 56 | Q8WUA7 | TBC1 Domain family member 22A |
| 35 | RIYQyIQSR | 269 | 277 | Q9Y463 | Dual specificity tyrosine-phosphorylation-regulated kinase 1B |
| 41 | RLLDRSPsRSAK | 301 | 312 | Q76039 | Cyclin-dependent kinase-like 5 |
| 72 | RVRQsPLATR | 40 | 49 | O75381 | Peroxisomal membrane protein PEX14 |
| 73 | RVYsPYNHR | 582 | 590 | Q9NS56 | E3 Ubiquitin-protein Topors |
| HLA B*0702 | | | | | |
| 270 | EPRsPSHSM | 746 | 754 | Q03164 | Histone-lysine N-methyltransferase MLL |
| 292 | KPRsPPRAL | 249 | 257 | Q86TG8 | Retrotransposon-derived protein PEG11 |
| 302 | QPRsPGPDYSL | 17 | 27 | Q99684 | Zinc finger protein Gfi-1 |
| 304 | QPRtPSPLVL | 172 | 181 | P33241 | Lymphocyte-specific protein 1 |
| 346 | RPTsRLNRL | 860 | 868 | Q15788 | Nuclear receptor coactivator 1 |
| 366 | RVRsPTRSP | 158 | 166 | Q03164 | Histone-lysine N-methyltransferase MLL |
| 387 | TPRsPPLGL | 755 | 763 | Q16584 | Mitogen-activated protein kinase kinase kinase 11 |
| Class II MHC Molecules (DRB1*0404, 0101 or DRB4*0103) | | | | | |
| 555 | DPTRRFFKVtPPPGSGPQ | 328 | 345 | P15391 | B-Lymphocyte antigen CD19 |
| 556 | SGPKPLFRRMsSLVGPTQ | 25 | 42 | P11836 | B-Lymphocyte antigen CD20 |

Column 2: Phosphopeptide sequences; pSer, pThr and pTyr are specified by s, t, and y, respectively.
Column 3 & 4: Entries define the location of the phosphopeptides within the sequence of the parent protein.
Column 6: Protein identifier in the UniProt database, www[dot]uniprot[dot]org
Column 7: Name of the protein in the UniProt database.

TABLE 16

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| Melanoma HLA A*0301 Phosphopeptides ||||||
| 1 | ALRSsPIMRK | 1168 | 1177 | O43314 | Inositol hexakisphosphate kinase 2 |
| 613 | AMRSsPIMRK | | | | |
| 614 | ALRSsPIMRY | | | | |
| 2 | ALYsGVHKK | 305 | 313 | O94885 | SAM and SH3 domain-containing protein 1 |
| 615 | AMYsGVHKK | | | | |
| 616 | ALYsGVHKY | | | | |
| 3 | DTVPLsPLKY | 418 | 427 | Q9UEY8 | Gamma-adducin |
| 617 | DLVPLsPLKK | | | | |
| 618 | DMVPLsPLKK | | | | |
| 4 | EMKKsPTSLK | 134 | 143 | Q9NYZ3 | G2 and S phase-expressed protein 1 |
| 619 | ELKKsPTSLK | | | | |
| 620 | ELKKsPTSLY | | | | |
| 5 | FRYsGKTEY | 345 | 353 | Q9HCM4 | Band 4.1-like protein 5 |
| 621 | FRYsGKTEK | | | | |
| 622 | FLYsGKETK | | | | |
| 623 | FLYsGKETY | | | | |
| 6 | FVSKVMIGsPKKV | 1433 | 1445 | Q68CZ2 | Tensin 3 |
| 7 | IISsPLTGK | 461 | 469 | Q9P275 | Ubiquitin thioesterase 36 |
| 624 | IISsPLKGY | | | | |
| 8 | ITQGtPLKY | 1459 | 1467 | Q9Y618 | Nuclear receptor corepressor 2 |
| 625 | ITQGtPLKK | | | | |
| 9 | KGIsSSSLKEK | 616 | 626 | P31629 | Transcription factor HIVEP2 |
| 626 | KLIsSSSLKEK | | | | |
| 627 | KMIsSSSLKEK | | | | |
| 628 | KLIsSSSLKEY | | | | |
| 10 | KIDsPTKVKK | 1008 | 1017 | Q15468 | SCL-interrupting locus protein |
| 629 | KLDsPTKVKK | | | | |
| 630 | KMDsPTKVKK | | | | |
| 631 | KLDsPTKVKY | | | | |
| 11 | KIFsKQQGK | 494 | 502 | Q16513 | S/T-protein kinase N2 |
| 632 | KLFsKQQGK | | | | |
| 633 | KMFsKQQGK | | | | |
| 634 | KLFsKQQGY | | | | |
| 635 | KIFsKQQGY | | | | |
| 12 | KIRSsPREAK | 36 | 45 | Q9H1E3 | Casein and cyclin-dependent kinases substrate |
| 636 | KLRSsPREAK | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 637 | KMRSsPREAK | | | | |
| 638 | KIRSsPREAY | | | | |
| 13 | KIRTsPTFR | 39 | 47 | P62750 | 60S Ribosomal protein L23a |
| 639 | KLRTsPTFK | | | | |
| 640 | KMRTsPTFK | | | | |
| 641 | KIRTsPTFY | | | | |
| 14 | KLFsPAHKK | 458 | 466 | Q8TAT5 | Endonuclease VIII-like 3 |
| 642 | KMFsPAHKK | | | | |
| 643 | KLFsPAHKY | | | | |
| 15 | KLRsPFLQK | 280 | 288 | Q9UJU6 | Drebrin-like protein |
| 644 | KMRsPFLQK | | | | |
| 645 | KLRsPFLQY | | | | |
| 16 | KLSsPRGGMKK | 212 | 222 | P18124 | 60S Ribosomal protein L7 |
| 646 | KMSsPRGGMKK | | | | |
| 647 | KLSsPRGGMK | | | | |
| 648 | KLSsPRGGMKY | | | | |
| 17 | KMPTtPVKAK | 47 | 56 | Q8WUA7 | TBC1 domain family member 22A |
| 649 | KLPTtPVKAK | | | | |
| 650 | KMPTtPVKAY | | | | |
| 18 | KRLsVERIY | 26 | 34 | P11388 | DNA topoisomerase 2-alpha |
| 651 | KLLsVERIK | | | | |
| 652 | KMLsVERIK | | | | |
| 19 | KRFsGTVRL | 47 | 55 | P62906 | 60S Ribosomal protein L10a |
| 653 | KLFsGTVRK | | | | |
| 654 | KMFsGTVRK | | | | |
| 20 | KRYsGNMEY | 275 | 283 | O95835 | Serine/threonine-protein kinase LATS1 |
| 655 | KLYsGNMEK | | | | |
| 656 | KMYsGNMEK | | | | |
| 21 | KSKsNPFLKK | 990 | 1000 | Q6WCQ1 | Myosin phosphatase Rho-interacting protein |
| 657 | KLKsNPDFLKK | | | | |
| 658 | KMKsNPDFLKK | | | | |
| 659 | KMKsNPDFLKY | | | | |
| 660 | KLKsNPDFLKY | | | | |
| 22 | KSKtPLVAR | 1137 | 1145 | P28290 | Sperm-specific antigen 2 |
| 661 | KSKtPLVAK | | | | |
| 662 | KLKtPLVAR | | | | |
| 663 | KMKtPLVAR | | | | |

TABLE 16-continued

Phosphopeptides Presented in Association with Class I MHC Molecules on Cancer Cells
with Sequence Variations for Use in Immunotherapy

| SEQ ID No. | Sequence | Start | Stop | UniProt | Source Protein |
|---|---|---|---|---|---|
| 664 | KLKtPLVAK | | | | |
| 665 | KMKtPLVAK | | | | |
| 666 | KSKtPLVAY | | | | |
| 23 | KSSsLGNLKK | 463 | 472 | Q86W92 | Liprin-beta-1 |
| 667 | KLSsLGNLKK | | | | |
| 668 | KMSsLGNLKK | | | | |
| 669 | KLSsLGNLKY | | | | |
| 670 | KMSsLGNLKY | | | | |
| 24 | KtLSPGKNGVVK | 1171 | 1182 | P04626 | Receptor tyrosine-protein kinase erbB-2 |
| 671 | KtLSPGKNGVVY | | | | |
| 25 | KTPTsPLKMK | 112 | 121 | O60264 | SWI/SNF-related regulator of chromatin subfamily A, # 5 |
| 672 | KLPTsPLKMK | | | | |
| 673 | KMPTsPLKMK | | | | |
| 674 | KTPTsPLKMY | | | | |
| 26 | KVHGsLARAGK | 1 | 11 | P62861 | 40S Ribosomal protein S30 |
| 675 | KLHGsLARAGK | | | | |
| 676 | KLHGsLARAGY | | | | |
| 677 | KVHGsLARAGY | | | | |
| 27 | KVLtPIKEK | 365 | 373 | Q8N960 | Centrosomal protein of 120 kDa |
| 678 | KLLtPIKEK | | | | |
| 679 | KMLtPIKEK | | | | |
| 680 | KVLtPIKEY | | | | |
| 681 | KLLtPIKEY | | | | |
| 28 | KVHGsLARAGK | 1 | 11 | P62861 | 40S Ribosomal protein S30 |
| 682 | KLHGsLARAGK | | | | |
| 683 | KMHGsLARAGK | | | | |
| 684 | KVHGsLARAGY | | | | |
| 29 | LLNKSsPVKK | 552 | 561 | O60318 | 80 kDa MCM3-associated protein |
| 685 | LMNKSsPVKK | | | | |
| 686 | LLNKSsPVKY | | | | |
| 687 | LMNKSsPVKY | | | | |
| 30 | MTRsPPRVSK | 249 | 258 | Q9BRL6 | Splicing factor, R/S-rich 2B |
| 688 | MLRsPPRVSK | | | | |
| 689 | MMRsPPRVSK | | | | |
| 690 | MTRsPPRVSY | | | | |
| 31 | NYVERKNsL | 54 | 62 | O43639 | Cytoplasmic protein NCK2 |
| 691 | NLVERKNsL | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 692 | NMVERKNsL | | | | |
| 693 | NLVERKNsK | | | | |
| 694 | NMVERKNsK | | | | |
| 695 | NYVERKNsK | | | | |
| 696 | NYVERKNsY | | | | |
| 32 | QVFsPKKGQK | 990 | 999 | Q5T200 | Zinc finger CCCH domain-containing protein 13 |
| 697 | QLFsPKKGQK | | | | |
| 698 | QMFsPKKGQK | | | | |
| 699 | QVFsPKKGQY | | | | |
| 33 | RAFsFSKTPK | 808 | 817 | Q9H8V3 | Protein ECT2 |
| 700 | RLFsFSKTPK | | | | |
| 701 | RMFsFSKTPK | | | | |
| 702 | RAFsFSKTPY | | | | |
| 34 | RILsPSMASK | 68 | 77 | Q9Y6A5 | Transforming acidic coiled-coil-containing protein 13 |
| 703 | RLLsPSMASK | | | | |
| 704 | RMLsPSMASK | | | | |
| 705 | RILsPSMASY | | | | |
| 35 | RIYQyIQSR | 269 | 277 | Q9Y463 | Dual specific Tyr-phosphorylation-regulated kinase 1B |
| 706 | RLYQyIQSR | | | | |
| 707 | RMYQyIQSR | | | | |
| 708 | RLYQyIQSK | | | | |
| 709 | RMYQyIQSK | | | | |
| 710 | RIYQyIQSY | | | | |
| 36 | RIYQyLQSRF | 269 | 278 | Q9Y463 | Dual specific Tyr-phosphorylation-regulated kinase 1B |
| 711 | RLYQyLQSRF | | | | |
| 712 | RMYQyLQSRF | | | | |
| 713 | RLYQyLQSRK | | | | |
| 714 | RMYQyLQSRK | | | | |
| 37 | RIYQyLQSRFY | 269 | 279 | Q9Y463 | Dual specific Tyr-phosphorylation-regulated kinase 1B |
| 715 | RLYQyLQSRFY | | | | |
| 716 | RMYQyLQSRFY | | | | |
| 717 | RLYQyLQSRFK | | | | |
| 718 | RMYQyLQSRFK | | | | |
| 38 | RKLsVILIL | 3 | 11 | Q13433 | Zinc transporter ZIP6 |
| 719 | RKLsVILIK | | | | |
| 720 | RLLsVILIK | | | | |
| 721 | RMLsVILIK | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 722 | RKLsVILIY | | | | |
| 39 | RLIsPYKKK | 358 | 366 | O14929 | Histone acetyltransferase type B catalytic subunit |
| 723 | RMIsPYKKK | | | | |
| 40 | RLKsPFRKK | 206 | 214 | Q92963 | GTP-binding protein Rit1 |
| 724 | RMKsPFRKK | | | | |
| 41 | RLLDRSPsRSAK | 301 | 312 | O76039 | Cyclin-dependent kinase-like 5 |
| 725 | RMLDRSPsRSAK | | | | |
| 42 | RLPsSTLKR | 813 | 821 | Q86Y91 | Kinesin-like protein KIF18B |
| 726 | RLPsSTLKK | | | | |
| 727 | RMPsSTLKK | | | | |
| 728 | RMPsSTLKR | | | | |
| 43 | RLRsAGAAQK | 38 | 47 | Q6PL18 | ATPase family AAA domain-containing protein 2 |
| 729 | RMRsAGAAQK | | | | |
| 44 | RLSsPISKR | 327 | 335 | Q99728 | BRCA1-associated RING domain protein 1 |
| 730 | RLSsPISKK | | | | |
| 731 | RMSsPISKR | | | | |
| 732 | RMSsPISKK | | | | |
| 733 | RLSsPISKY | | | | |
| 45 | RLSsPVLHR | | | | |
| 734 | RLSsPVLHK | | | | |
| 735 | RMSsPVLHK | | | | |
| 736 | RLSsPVLHY | | | | |
| 46 | RLSsRYSQK | 154 | 162 | Q8WUB2 | Uncharacterized protein C12orf24 |
| 737 | RMSsRYSQK | | | | |
| 738 | RLSsRYSQY | | | | |
| 47 | RMYsKSRDH | 663 | 671 | Q13427 | Peptidyl-prolyl cis-trans isomerase G |
| 739 | RMYsKSRDK | | | | |
| 740 | RMYsKSRDY | | | | |
| 741 | RLYsKSRDK | | | | |
| 48 | RRPsLVHGY | | | | |
| 742 | RRPsLVHGK | | | | |
| 743 | RLPsLVHGY | | | | |
| 49 | RSAsSATQVHK | | | | No database hit |
| 744 | RLAsSATQVHK | | | | |
| 745 | RMAsSATQVHK | | | | |
| 746 | RSAsSATQVHY | | | | |
| 50 | RSLsVEIVY | 863 | 871 | Q9NS56 | E6 Ubiquitin-protein ligase Topors |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 747 | RLLsVEIVY | | | | |
| 748 | RSLsVEIVK | | | | |
| 749 | RLLsVEIVK | | | | |
| 51 | RSMsMPVAH | 429 | 437 | Q9Y4H2 | Insulin receptor substrate 2, IRS2 |
| 750 | RSMsMPVAK | | | | |
| 751 | RLMsMPVAK | | | | |
| 752 | RLMsMPVAY | | | | |
| 52 | SRRsPLLK | 874 | 882 | O95235 | Kinesin-like protein KIF20A |
| 753 | RLRRsPLLK | | | | |
| 754 | RMRRsPLLK | | | | |
| 755 | RSRRsPLLY | | | | |
| 53 | RSRsPPPVSK | 188 | 197 | Q01130 | Splicing factor, R/S-rich 2 |
| 756 | RLRsPPPVSK | | | | |
| 757 | RMRsPPPVSK | | | | |
| 758 | RSRsPPPVSY | | | | |
| 54 | RSRTsPITRR | 1971 | 1980 | Q9UQ35 | S/R repetitive matrix protein 2 |
| 759 | RLRTsPITRK | | | | |
| 760 | RMRTsPITRK | | | | |
| 761 | RLRTsPITRR | | | | |
| 762 | RSRTsPITRY | | | | |
| 55 | RSSsLIRHK | 388 | 396 | P17029 | Zinc finger protein with KRAB and SCAN domains 1 |
| 763 | RLSsLIRHK | | | | |
| 764 | RMSsLIRHK | | | | |
| 765 | RSSsLIRHY | | | | |
| 56 | RSVsLSMRK | 163 | 171 | O60238 | BCL2/adenovirus E1B 19 kDa interacting protein 3-like |
| 766 | RLVsLSMRK | | | | |
| 767 | RMVsLSMRK | | | | |
| 768 | RSVsLSMRY | | | | |
| 57 | RSYsGSRsR | 189 | 197 | Q13247 | Splicing factor, R/S-rich 6 |
| 769 | RLYsGSRsK | | | | |
| 770 | RSYsGSRsK | | | | |
| 771 | RSYsGSRsY | | | | |
| 772 | RLYsGSRsY | | | | |
| 58 | RSYsPDHRQK | 122 | 131 | Q14241 | Transcription elongation factor B polypeptide 3 |
| 773 | RLYsPDHRQK | | | | |
| 774 | RMYsPDHRQK | | | | |
| 775 | RSYsPDHRQY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 59 | RSYsPERSK | 152 | 160 | Q8NEY8 | Periphilin-1 (gastric cancer antigen Ga50) |
| 776 | RLYsPERSK | | | | |
| 777 | RMYsPERSK | | | | |
| 778 | RSYsPERSY | | | | |
| 60 | RSYsPRNSR | 140 | 148 | O75494 | Splicing factor, R/S-rich 13A |
| 779 | RLYsPRNSK | | | | |
| 780 | RMYsPRNSK | | | | |
| 781 | RSYsPRNSY | | | | |
| 61 | RSYsYPRQK | 648 | 656 | Q9H706 | Protein FAM59A |
| 782 | RLYsYPRQK | | | | |
| 783 | RMYsYPRQK | | | | |
| 784 | RSYsYPRQY | | | | |
| 62 | RSYVTTSTRTYsLG | 28 | 41 | P08670 | Vimentin |
| 785 | RLYVTTSTRTYsLK | | | | |
| 786 | RMYVTTSTRTYsLK | | | | |
| 787 | RLYVTTSTRTYsLY | | | | |
| 788 | RMYVTTSTRTYsLY | | | | |
| 63 | RTPsFLKKNK | 690 | 699 | Q9UEY8 | Gamma-adducin |
| 789 | RLPsFLKKNK | | | | |
| 790 | RMPsFLKKNK | | | | |
| 791 | RTPsFLKKNY | | | | |
| 64 | RTYKsPLRH | 175 | 183 | Q6ICC9 | Protein LDOC1L |
| 792 | RLYKsPLRK | | | | |
| 793 | RMYKsPLRK | | | | |
| 794 | RLYKsPLRH | | | | |
| 795 | RMYKsPLRH | | | | |
| 796 | RTYKsPLRK | | | | |
| 797 | RTYKsPLRY | | | | |
| 65 | RVAsPTSGVK | 1097 | 1106 | Q9Y4H2 | Insulin receptor substrate 2 |
| 798 | RLAsPTSGVK | | | | |
| 799 | RMAsPTSGVK | | | | |
| 800 | RVAsPTSGVY | | | | |
| 66 | RVAsPTSGVKR | 1097 | 1107 | Q9Y4H2 | Insulin receptor substrate 2 |
| 801 | RLAsPTSGVKK | | | | |
| 802 | RMAsPTSGVKK | | | | |
| 803 | RLAsPTSGVKY | | | | |
| 804 | RMAsPTSGVKY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 805 | RVAsPTSGVKK | | | | |
| 67 | RVKLPsGSKK | 147 | 156 | P62917 | 60S Ribosomal protein L8 |
| 806 | RLKLPsGSKK | | | | |
| 807 | RMKLPsGSKK | | | | |
| 808 | RLKLPsGSKY | | | | |
| 809 | RMKLPsGSKY | | | | |
| 68 | RVKsPGsGHVK | 437 | 447 | Q9C040 | Tripartite motif-containing protein 2 |
| 810 | RLKsPGsGHVK | | | | |
| 811 | RMKsPGsGHVK | | | | |
| 812 | RVKsPGsGHVY | | | | |
| 69 | RVKsPSPKSER | 943 | 953 | O15042 | U2-associated protein SR140 |
| 813 | RLKsPSPKSEK | | | | |
| 814 | RMKsPSPKSEK | | | | |
| 815 | RLKsPSPKSER | | | | |
| 816 | RVKsPSPKSEY | | | | |
| 70 | RVKtPTSQSYR | 885 | 895 | Q9Y2X9 | Zinc finger protein 281 |
| 817 | RLKtPTSQSYK | | | | |
| 818 | RMKtPTSQSYK | | | | |
| 819 | RLKtPTSQSYR | | | | |
| 820 | RVKtPTSQSYK | | | | |
| 821 | RVKtPTSQSYY | | | | |
| 71 | RVKTtPLRR | 658 | 666 | P46100 | Transcriptional regulator ATRX |
| 822 | RLKTtPLRK | | | | |
| 823 | RMKTtPLRK | | | | |
| 824 | RLKTtPLRR | | | | |
| 825 | RVKTtPLRY | | | | |
| 72 | RVRQsPLATR | 40 | 49 | O75381 | Peroxisomal membrane protein PEX14 |
| 826 | RLRQsPLATK | | | | |
| 827 | RMRQsPLATK | | | | |
| 828 | RLRQsPLATR | | | | |
| 829 | RVRQsPLATY | | | | |
| 73 | RVYsPYNHR | 582 | 590 | Q9NS56 | E3 ubiquitin-protein Topors |
| 830 | RLYsPYNHK | | | | |
| 831 | RVYsPYNHK | | | | |
| 832 | RLYsPYNHR | | | | |
| 833 | RVYsPYNHY | | | | |
| 74 | SLFsPRRNK | 841 | 849 | O94909 | Protein MICAL-3 |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 834 | SMFsPRRNK | | | | |
| 835 | SLFsPRRNY | | | | |
| 75 | SLLNKSsPVKK | 551 | 561 | O60318 | 80 kDa MCM3-associated protein |
| 836 | SLLNKSsPVKY | | | | |
| 837 | SMLNKSsPVKK | | | | |
| 76 | SLMsPGRRK | 204 | 212 | Q14207 | Protein NPAT |
| 838 | SMMsPGRRK | | | | |
| 839 | SLMsPGRRY | | | | |
| 77 | SVKsPVTVK | 329 | 337 | Q9HCS4 | Transcription factor 7-like 1 |
| 840 | SLKsPVTVK | | | | |
| 841 | SMKsPVTVK | | | | |
| 842 | SVKsPVTVY | | | | |
| 78 | SVRRsVLMK | 223 | 231 | Q9H2J4 | Phosducin-like protein 3 |
| 843 | SLRRsVLMK | | | | |
| 844 | SMRRsVLMK | | | | |
| 845 | SVRRsVLMY | | | | |
| 79 | SVYsPVKKK | 136 | 144 | O15504 | Nucleoporin-like 2 |
| 846 | SLYsPVKKK | | | | |
| 847 | SMYsPVKKK | | | | |
| 848 | SVYsPVKKY | | | | |
| 80 | VMIGsPKKV | | | | |
| 849 | VMIGsPKKY | | | | |
| 850 | VLIGsPKKY | | | | |
| 81 | VSKVMIGsPKKV | 1434 | 1445 | Q68CZ2 | Tensin 3 |
| 851 | VLKVMIGsPKKK | | | | |
| 852 | VLKVMIGsPKK | | | | |
| 853 | VLKVMIGsPK | | | | |
| 854 | VMKVMIGsPKKY | | | | |
| 855 | VSKVMIGsPKKY | | | | |
| 856 | VMKVMIGsPK | | | | |
| 82 | VTQtPPYVKK | 451 | 460 | Q659C4 | La-related protein 1B |
| 857 | VLQtPPYVKK | | | | |
| 858 | VMQtPPYVKK | | | | |
| 859 | VLQtPPYVKY | | | | |
| 860 | VTQtPPYVKY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| | Melanoma HLA-A*0101 Phosphopeptides |||||
| 83 | AEEEIGtPRKF | 326 | 336 | P28749 | Retinoblastoma-like protein 1 |
| 861 | AEEEIGtPRKY | | | | |
| 862 | AEDEIGtPRKY | | | | |
| 863 | AEDEIGtPRKF | | | | |
| 864 | ATEEIGtPRKY | | | | |
| 865 | ASEEIGtPRKF | | | | |
| 866 | ASDEIGtPRKF | | | | |
| 867 | ATDEIGtPRKF | | | | |
| 868 | ATEEIGtPRKF | | | | |
| 84 | DTVPLsPLKY | 418 | 427 | Q9UEY8 | Gamma-adducin |
| 869 | DSVPLsPLKY | | | | |
| 870 | DTEPLsPLKY | | | | |
| 871 | DTDPLsPLKY | | | | |
| 872 | DSEPLsPLKY | | | | |
| 873 | DSDPLsPLKY | | | | |
| 85 | ESEsLPRY | 447 | 454 | Q8TD91 | Melanoma-associated antigen C3 |
| 874 | ESDsLPRY | | | | |
| 875 | ETEsLPRY | | | | |
| 876 | ETDsLPRY | | | | |
| 86 | FIEsPSKL | 1104 | 1011 | Q6N021 | Methylcytosine dioxygenase TET2 |
| 877 | FIEsPSKY | | | | |
| 878 | FSEsPSKL | | | | |
| 879 | FTEsPSKL | | | | |
| 880 | FSEsPSKY | | | | |
| 881 | FTEsPSKY | | | | |
| 87 | FSSsHEGFSY | 318 | 327 | P41161 | ETS translocation variant 5 |
| 882 | FSDsHEGFSY | | | | |
| 883 | FTEsHEGFSY | | | | |
| 884 | FSEsHEGFSY | | | | |
| 885 | FTDsHEGFSY | | | | |
| 88 | FSsSHEGFSY | 318 | 327 | P41161 | ETS translocation variant 5 |
| 886 | FTsSHEGFSY | | | | |
| 89 | GEEsSDDGKKY | 135 | 145 | Q9P2B7 | UPF0501 protein KIAA1430 |
| 887 | GSEsSDDGKKY | | | | |
| 888 | GSDsSDDGKKY | | | | |
| 889 | GTDsSDDGKKY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 890 | GTEsSDDGKKY | | | | |
| 90 | GtLPKY | 291 | 296 | P12271 | Retinaldeyhde-binding protein |
| 91 | IIEtPHKEI | 71 | 79 | O96020 | G1/S-specific cyclin-E2 |
| 891 | IIEtPHKEY | | | | |
| 892 | ISEtPHKEI | | | | |
| 893 | ITEtPHKEI | | | | |
| 894 | ISDtPHKEI | | | | |
| 895 | ITDtPHKEI | | | | |
| 896 | ISEtPHKEY | | | | |
| 897 | ISDtPHKEY | | | | |
| 898 | ITDtPHKEY | | | | |
| 899 | ITEtPHKEY | | | | |
| 92 | ISFSAHtDY | 391 | 399 | Q9UKF6 | Cleavage and polyadenylation specificity factor subunit 3 |
| 900 | ISDSAHtDY | | | | |
| 901 | ISESAHtDY | | | | |
| 902 | ITESAHtDY | | | | |
| 903 | ITDSAHtDY | | | | |
| 93 | ISSsMHSLY | 222 | 230 | P50616 | Protein Tob1 |
| 904 | ISDsMHSLY | | | | |
| 905 | ISEsMHSLY | | | | |
| 906 | ITEsMHSLY | | | | |
| 907 | ITDsMHSLY | | | | |
| 94 | ITQGtPLKY | 1459 | 1467 | Q9Y618 | Nuclear receptor corepressor 2 |
| 908 | ITDGtPLKY | | | | |
| 909 | ITEGtPLKY | | | | |
| 910 | ISEGtPLKY | | | | |
| 911 | ISDGtPLKY | | | | |
| 95 | IVRyHQL | 71 | 77 | A6NC51 | Transmembrane protein 150B |
| 96 | IVtDRDPL | 514 | 521 | Q92932 | Receptor-type Y-protein phosphatase N2 |
| 912 | IStDRDPL | | | | |
| 913 | ITtDRDPL | | | | |
| 914 | IVtDRDPY | | | | |
| 915 | IStDRDPY | | | | |
| 916 | ITtDRDPY | | | | |
| 97 | KSEsRQERY | 146 | 154 | Q05682 | Caldesmon |
| 917 | KTDsRQERY | | | | |
| 918 | KSDsRQERY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 919 | KTEsRQERY | | | | |
| 98 | LLDPSRSYsY | 643 | 652 | Q9H706 | Protein FAM59A |
| 920 | LSDPSRSYsY | | | | |
| 921 | LSEPSRSYsY | | | | |
| 922 | LTEPSRSYsY | | | | |
| 923 | LTDPSRSYsY | | | | |
| 99 | LLDtPVKTQY | 1119 | 1128 | Q6N021 | Probable methylcytosine dioxygenase TET2 |
| 924 | LSDtPVKTQY | | | | |
| 925 | LSEtPVKTQY | | | | |
| 926 | LTEtPVKTQY | | | | |
| 927 | LTDtPVKTQY | | | | |
| 100 | LSDsDTEAKL | 2040 | 2049 | Q92614 | Myosin-XVIIIa |
| 928 | LSEsDTEAKL | | | | |
| 929 | LTEsDTEAKL | | | | |
| 930 | LTDsDTEAKL | | | | |
| 931 | LSEsDTEAKY | | | | |
| 932 | LSDsDTEAKY | | | | |
| 933 | LTDsDTEAKY | | | | |
| 934 | LTEsDTEAKY | | | | |
| 101 | MTDtYRLKY | 1045 | 1053 | Q70EK8 | Inactive ubiquitin carboxyl-terminal hydrolase 53 |
| 935 | MSDtYRLKY | | | | |
| 936 | MSEtYRLKY | | | | |
| 937 | MTEtYRLKY | | | | |
| 102 | NTDsPLRY | 149 | 156 | P08865 | 40S Ribosomal protein SA |
| 938 | NSDsPLRY | | | | |
| 939 | NTEsPLRY | | | | |
| 940 | NSEsPLRY | | | | |
| 103 | QLDsPQRALY | 59 | 68 | Q16587 | Zinc finger protein 74 |
| 941 | QSDsPQRALY | | | | |
| 942 | QSEsPQRALY | | | | |
| 943 | QTEsPQRALY | | | | |
| 944 | QTDsPQRALY | | | | |
| 104 | RGDsPKIDL | 433 | 441 | Q96B97 | SH3 domain-containing kinase-binding protein 1 |
| 945 | RSDsPKIDL | | | | |
| 946 | RTDsPKIDL | | | | |
| 947 | RTEsPKIDL | | | | |
| 948 | RSEsPKIDL | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 949 | RSDsPKIDY | | | | |
| 950 | RSEsPKIDY | | | | |
| 951 | RTEsPKIDY | | | | |
| 952 | RTDsPKIDY | | | | |
| 105 | RRLsFLVSY | 67 | 75 | P47897 | Glutamine-tRNA synthetase |
| 106 | RSDsRAQAV | 116 | 124 | P55884 | Eukaryotic translation initiation factor 3 subunit B |
| 953 | RSEsRAQAV | | | | |
| 954 | RTEsRAQAV | | | | |
| 955 | RTDsRAQAV | | | | |
| 956 | RSEsRAQAY | | | | |
| 957 | RSDsRAQAY | | | | |
| 958 | RTDsRAQAY | | | | |
| 959 | RTEsRAQAY | | | | |
| 107 | RSDsYVELSQY | 10 | 20 | P52298 | Nuclear cap-binding protein subunit 2 |
| 960 | RSEsYVELSQY | | | | |
| 961 | RTEsYVELSQY | | | | |
| 962 | RTDsYVELSQY | | | | |
| 108 | RSIsVGENL | 1260 | 1268 | O60336 | Mitogen-activated protein kinase-binding protein 1 |
| 963 | RSDsVGENY | | | | |
| 964 | RSEsVGENY | | | | |
| 965 | RSDsVGENL | | | | |
| 966 | RSEsVGENL | | | | |
| 109 | RTEPSKsPGSLRY | 695 | 707 | Q9UGU0 | Transcription factor 20 |
| 967 | RSDPSKsPGSLRY | | | | |
| 968 | RTDPSKsPGSLRY | | | | |
| 969 | RSEPSKsPGSLRY | | | | |
| 110 | SIDsPQKL | 724 | 731 | Q12888 | Tumor suppressor p53-binding protein 1 |
| 970 | SSDsPQKL | | | | |
| 971 | SSEsPQKL | | | | |
| 972 | SSEsPQKY | | | | |
| 973 | SSDsPQKY | | | | |
| 974 | STEsPQKY | | | | |
| 975 | STDsPQKY | | | | |
| 976 | SIDsPQKY | | | | |
| 111 | SLDsPSYVLY | 57 | 66 | P49354 | Protein farnesyltransferase type-1 subunit alpha |
| 977 | SSDsPSYVLY | | | | |
| 978 | SSEsPSYVLY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 979 | STEsPSYVLY | | | | |
| 980 | STDsPSYVLY | | | | |
| 981 | SLEsPSYVLY | | | | |
| 112 | SREKHsEI | 64 | 71 | Q9HBZ2 | Aryl hydrocarbon receptor nuclear translocator 2 |
| 982 | SSDKHsEY | | | | |
| 983 | SSEKHsEY | | | | |
| 984 | STEKHsEY | | | | |
| 985 | STDKHsEY | | | | |
| 986 | SRDKHsEY | | | | |
| 113 | SSDPASQLsY | 581 | 590 | Q08050 | Foxhead box protein M1 |
| 987 | STDPASQLsY | | | | |
| 988 | SSEPASQLsY | | | | |
| 989 | STEPASQLsY | | | | |
| 114 | SSDsPTNHFF | 850 | 859 | Q15648 | Mediator of RNA polymerase II transcription subunit 1 |
| 990 | SSEsPTNHFY | | | | |
| 991 | STDsPTNHFY | | | | |
| 992 | STEsPTNHFY | | | | |
| 115 | STDsETLRY | 281 | 289 | Q9HCH5 | Synaptotagmin-like protein 2 |
| 993 | SSDsETLRY | | | | |
| 994 | STEsETLRY | | | | |
| 995 | SSEsETLRY | | | | |
| 116 | SVDIsPTRL | 690 | 698 | Q9P2Q2 | FERM domain-containing protein 4A |
| 996 | SSDIsPTRL | | | | |
| 997 | STDIsPTRL | | | | |
| 998 | STEIsPTRL | | | | |
| 999 | STEIsPTRL | | | | |
| 1000 | SVDIsPTRY | | | | |
| 1001 | SSDIsPTRY | | | | |
| 1002 | SSEIsPTRY | | | | |
| 1003 | STDIsPTRY | | | | |
| 1004 | STEIsPTRY | | | | |
| 117 | TMAsPGKDNY | 3 | 12 | O60684 | Importin subunit alpha-7 |
| 1005 | TMEsPGKDNY | | | | |
| 1006 | TMDsPGKDNY | | | | |
| 1007 | TSDsPGKDNY | | | | |
| 1008 | TSEsPGKDNY | | | | |
| 1009 | TTAsPGKDNY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1010 | TSAsPGKDNY | | | | |
| 1011 | TTDsPGKDNY | | | | |
| 1012 | TTEsPGKDNY | | | | |
| 118 | TSEtPDYLLKY | 503 | 513 | P55199 | RNA polymerase II elongation factor ELL |
| 1013 | TSDtPDYLLKY | | | | |
| 1014 | TTDtPDYLLKY | | | | |
| 1015 | TTEtPDYLLKY | | | | |
| Melanoma HLA-B*4402 Phosphopeptides | | | | | |
| 120 | AEEEIGtPRKF | 326 | 336 | P28749 | Retinoblastoma-like protein 1 |
| 1016 | AEEEIGtPRKY | | | | |
| 1017 | AEEEIGtPRKW | | | | |
| 121 | AENsPTRQQF | 93 | 102 | Q86XP3 | ATP-dependent RNA helicase DDX42 |
| 1018 | AENsPTRQQY | | | | |
| 1019 | AENsPTRQQW | | | | |
| 122 | AESsPTAGKKL | 799 | 809 | Q8IWB9 | Testis-expressed sequence 2 protein |
| 1020 | AESsPTAGKKF | | | | |
| 1021 | AESsPTAGKKY | | | | |
| 1022 | AESsPTAGKKW | | | | |
| 123 | AtAGPRLGW | 621 | 629 | Q86W92 | Liprin-beta-1 |
| 1023 | AtAGPRLGF | | | | |
| 1024 | AtAGPRLGY | | | | |
| 124 | DERLRINsL | 49 | 57 | O60783 | 28S Ribosomal protein S14, mitochondrial |
| 1025 | DERLRINsF | | | | |
| 1026 | DERLRINsY | | | | |
| 1027 | DERLRINsW | | | | |
| 125 | DQFERIKtL | 42 | 50 | P17612 | cAMP-dependent protein kinase catalytic subunit alpha |
| 1028 | DEFERIKtF | | | | |
| 1029 | DEFERIKtY | | | | |
| 1030 | DEFERIKtW | | | | |
| 126 | DQISHRAsL | 277 | 285 | Q7Z2W4 | Zinc finger CCCH-type antiviral protein 1 |
| 1031 | DEISHRAsF | | | | |
| 1032 | DEISHRAsY | | | | |
| 1033 | DEISHRAsW | | | | |
| 127 | EEsSDDGKKY | 136 | 145 | Q9P2B7 | UPF0501 protein KIAA1430 |
| 1034 | EEsSDDGKKF | | | | |
| 1035 | EEsSDDGKKW | | | | |
| 128 | EESsDDGKKY | 136 | 145 | Q9P2B7 | UPF0501 protein KIAA1430 |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1036 | EESsDDGKKF | | | | |
| 1037 | EESsDDGKKW | | | | |
| 129 | GEEsSDDGKKY | 135 | 145 | Q9P2B7 | UPF0501 protein KIAA1430 |
| 1038 | GEEsSDDGKKF | | | | |
| 1039 | GEEsSDDGKKW | | | | |
| 130 | KEMsPTRQL | 36 | 44 | Q4G0N7 | UPF0731 protein C6orf225 |
| 1040 | KEMsPTRQF | | | | |
| 1041 | KEMsPTRQY | | | | |
| 1042 | KEMsPTRQW | | | | |
| 131 | RQKsPLFQF | 240 | 248 | Q8WY36 | HMG box transcription factor BBX |
| 1043 | REKsPLFQF | | | | |
| 1044 | REKsPLFQY | | | | |
| 1045 | REKsPLFQW | | | | |
| 132 | SEGsLHRKY | 81 | 89 | Q9ULM0 | Pleckstrin homology domain-containing family H, #1 |
| 1046 | SEGsLHRKF | | | | |
| 1047 | SEGsLHRKW | | | | |

Melanoma HLA-B*2705 Phosphopeptide

| 133 | ARFsPDDKYSR | 33 | 43 | Q9NPE3 | H/ACA ribonucleoprotein complex subunit 3 |
| 1048 | ARFsPDDKYSF | | | | |
| 1049 | ARFsPDDKYSK | | | | |
| 1050 | ARFsPDDKYSY | | | | |
| 134 | FRYsGKTEY | 345 | 353 | Q9HCM4 | Band 4.1-like protein 5 |
| 1051 | FRYsGKTEF | | | | |
| 1052 | FRYsGKTER | | | | |
| 1053 | FRYsGKTEK | | | | |
| 135 | GRKsPPPSF | 713 | 721 | B4DLE8 | cDNA FLJ60082, similar to Uro-adherence factor A |
| 1054 | GRKsPPPSK | | | | |
| 1055 | GRKsPPPSY | | | | |
| 1056 | GRKsPPPSR | | | | |
| 136 | GRLGsPHRR | 109 | 117 | Q6UUV9 | CREB-regulated transcription coactivator 1 |
| 1057 | GRLGsPHRF | | | | |
| 1058 | GRLGsPHRY | | | | |
| 1059 | GRLGsPHRK | | | | |
| 137 | GRLsPKASQVK | 1078 | 1088 | Q8IVL1 | Neuron navigator 2 |
| 1060 | GRLsPKASQVY | | | | |
| 1061 | GRLsPKASQVF | | | | |
| 1062 | GRLsPKASQVR | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 138 | GRLsPVPVPR | 132 | 141 | Q9UKM9 | RNA-binding protein Raly |
| 1063 | GRLsPVPVPY | | | | |
| 1064 | GRLsPVPVPF | | | | |
| 1065 | GRLsPVPVPK | | | | |
| 139 | GRSsTASLVKR | 558 | 568 | O15213 | WD repeat-containing protein 46 |
| 1066 | GRSsTASLVKY | | | | |
| 1067 | GRSsTASLVKF | | | | |
| 1068 | GRSsTASLVKKK | | | | |
| 140 | HRLsPVKGEF | 367 | 376 | Q9Y2L9 | Leucine-riech repeat and calponin homology domain-containing protein 1 |
| 1069 | HRLsPVKGEY | | | | |
| 1070 | HRLsPVKGEK | | | | |
| 1071 | HRLsPVKGER | | | | |
| 141 | HRNsNPVIAEL | 267 | 277 | Q8IZ21 | Phosphatase and actin regulator 4 |
| 1072 | HRNsNPVIAEF | | | | |
| 1073 | HRNsNPVIAEY | | | | |
| 1074 | HRNsNPVIAEK | | | | |
| 1075 | HRNsNPVIAER | | | | |
| 142 | KRAsGQAFEL | 13 | 22 | P16949 | STMN1, Stathman, leukemia associated phosphoprotein p18/metabolism |
| 1076 | KRAsGQAFEK | | | | |
| 1077 | KRAsGQAFEF | | | | |
| 1078 | KRAsGQAFEY | | | | |
| 1079 | KRAsGQAFER | | | | |
| 143 | KRAsFAKSV | 349 | 357 | A6PVV2 | WNK lysine deficient protein kinase 2 |
| 1080 | KRAsFAKSL | | | | |
| 1081 | KRAsFAKSF | | | | |
| 1082 | KRAsFAKSY | | | | |
| 1083 | KRAsFAKSK | | | | |
| 1084 | KRAsFAKSR | | | | |
| 144 | KRASsPFRR | 619 | 627 | Q14978 | Nucleolar and coiled-body phosphoprotein 1 |
| 1085 | KRASsPFRL | | | | |
| 1086 | KRASsPFRF | | | | |
| 1087 | KRASsPFRY | | | | |
| 1088 | KRASsPFRK | | | | |
| 145 | KRAsVFVKL | 153 | 161 | P50502 | Hsc70-interacting protein |
| 1089 | KRAsVFVKF | | | | |
| 1090 | KRAsVFVKY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1091 | KRAsVFVKK | | | | |
| 1092 | KRAsVFVKR | | | | |
| 146 | KRFsFKK | 156 | 162 | P29966 | Myristoylated A-rich C-kinase substrate |
| 1093 | KRFsFKR | | | | |
| 1094 | KRFsFKF | | | | |
| 1095 | KRFsFKY | | | | |
| 1096 | KRFsFKL | | | | |
| 147 | KRFsFKKSF | 156 | 162 | P29966 | Myristoylated A-rich C-kinase substrate |
| 1097 | KRFsFKKSL | | | | |
| 1098 | KRFsFKKSY | | | | |
| 1099 | KRFsFKKSK | | | | |
| 1100 | KRFsFKKSR | | | | |
| 148 | KRFsGTVRL | 47 | 55 | P62906 | 60S Ribosomal protein L10a |
| 1101 | KRFsGTVRF | | | | |
| 1102 | KRFsGTVRY | | | | |
| 1103 | KRFsGTVRK | | | | |
| 1104 | KRFsGTVRR | | | | |
| 149 | KRLsPAPQL | 51 | 59 | Q9UH99 | SUN domain-containing protein 2 |
| 1105 | KRLsPAPQF | | | | |
| 1106 | KRLsPAPQY | | | | |
| 1107 | KRLsPAPQK | | | | |
| 1108 | KRLsPAPQR | | | | |
| 150 | KRLsVERIY | 26 | 34 | P11388 | DNA topoisomerase 2-alpha |
| 1109 | KRLsVERIK | | | | |
| 1110 | KRLsVERIF | | | | |
| 1111 | KRLsVERIR | | | | |
| 151 | KRMsPKPL | 17 | 25 | P41208 | Centrin-2 |
| 1112 | KRMsPKPF | | | | |
| 1113 | KRMsPKPY | | | | |
| 1114 | KRMsPKPK | | | | |
| 1115 | KRMsPKPR | | | | |
| 152 | KRYsGNMEY | 275 | 283 | O95835 | S/T-protein kinase LATS1 |
| 1116 | KRYsGNMEK | | | | |
| 1117 | KRYsGNMEF | | | | |
| 1118 | KRYsGNMEM | | | | |
| 153 | MRLsRELQL | 360 | 368 | Q15051 | IQ calmodulin-binding motif-containing protein 1 |
| 1119 | MRLsRELQF | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1120 | MRLsRELQY | | | | |
| 1121 | MRLsRELQR | | | | |
| 154 | NRYtNRVVTL | 183 | 192 | P50750 | Cell division protein kinase 9 |
| 1122 | NRYtNRVVTF | | | | |
| 1123 | NRYtNRVVTY | | | | |
| 1124 | NRYtNRVVTK | | | | |
| 1125 | NRYtNRVVTR | | | | |
| 155 | RRFsPPRRM | 248 | 256 | Q15287 | RNA-binding protein with serine-rich domain 1 |
| 1126 | RRFsPPRRK | | | | |
| 1127 | RRFsPPRRF | | | | |
| 1128 | RRFsPPRRY | | | | |
| 1129 | RRFsPPRRR | | | | |
| 156 | RRFsRSPIR | 2026 | 2034 | P18583 | Protein SON |
| 1130 | RRFsRSPIK | | | | |
| 1131 | RRFsRSPIF | | | | |
| 1132 | RRFsRSPIY | | | | |
| 1133 | RRFsRSPIL | | | | |
| 157 | RRFsRsPIR | 2026 | 2034 | P18583 | Protein SON |
| 1134 | RRFsRsPIL | | | | |
| 1135 | RRFsRsPIF | | | | |
| 1136 | RRFsRsPIY | | | | |
| 1137 | RRFsRsPIK | | | | |
| 158 | RRFsRSPIRR | 2026 | 2935 | P18583 | Protein SON |
| 1138 | RRFsRSPIRK | | | | |
| 1139 | RRFsRSPIRF | | | | |
| 1140 | RRFsRSPIRY | | | | |
| 1141 | RRFsRSPIRL | | | | |
| 159 | RRFsRsPIRR | 2026 | 2935 | P18583 | Protein SON |
| 1142 | RRFsRsPIRL | | | | |
| 1143 | RRFsRsPIRF | | | | |
| 1144 | RRFsRsPIRY | | | | |
| 1145 | RRFsRsPIRK | | | | |
| 160 | RRIsGVDRY | 52 | 60 | O15239 | NADH dehydrogenase 1 α subcomplex subunit 1 |
| 1146 | RRIsGVDRK | | | | |
| 1147 | RRIsGVDRF | | | | |
| 1148 | RRIsGVDRR | | | | |
| 161 | RRIsGVDRYY | 52 | 60 | O15239 | NADH dehydrogenase 1 α subcomplex subunit 1 |

TABLE 16-continued

Phosphopeptides Presented in Association with Class I MHC Molecules on Cancer Cells
with Sequence Variations for Use in Immunotherapy

| SEQ ID No. | Sequence | Start | Stop | UniProt | Source Protein |
|---|---|---|---|---|---|
| 1149 | RRIsGVDRYL | | | | |
| 1150 | RRIsGVDRYF | | | | |
| 1151 | RRIsGVDRYK | | | | |
| 1152 | RRIsGVDRYR | | | | |
| 162 | RRKsQLDSL | 159 | 167 | Q14693 | Phosphatidate phosphatase LPIN1 |
| 1153 | RRKsQLDSF | | | | |
| 1154 | RRKsQLDSY | | | | |
| 1155 | RRKsQLDSK | | | | |
| 1156 | RRKsQLDSR | | | | |
| 163 | RRKsQVAEL | 244 | 252 | Q9BYG3 | MKI67 FHA domain-interact nucleolar phosphoprotein |
| 1157 | RRKsQVAEF | | | | |
| 1158 | RRKsQVAEY | | | | |
| 1159 | RRKsQVAEK | | | | |
| 1160 | RRKsQVAER | | | | |
| 164 | RRLsADIRL | 744 | 752 | O60307 | Microtubule-associated S/T-protein kinase 3 |
| 1161 | RRLsADIRF | | | | |
| 1162 | RRLsADIRY | | | | |
| 1163 | RRLsADIRK | | | | |
| 1164 | RRLsADIRR | | | | |
| 165 | RRLsFLVSY | 67 | 75 | P47897 | Glutaminyl-tRNA synthetase |
| 1165 | RRLsFLVSL | | | | |
| 1166 | RRLsFLVSF | | | | |
| 1167 | RRLsFLVSK | | | | |
| 1168 | RRLsFLVSR | | | | |
| 166 | RRLsGGSHSY | 332 | 341 | Q13905 | Rap guanine nucleotide exchange factor 1 |
| 1169 | RRLsGGSHSL | | | | |
| 1170 | RRLsGGSHSF | | | | |
| 1171 | RRLsGGSHSM | | | | |
| 167 | RRLsGPLHTL | 610 | 619 | Q86Y91 | Kinesin-like protein KIF 18B |
| 1172 | RRLsGPLHTF | | | | |
| 1173 | RRLsGPLHTY | | | | |
| 1174 | RRLsGPLHTM | | | | |
| 168 | RRMsLLSVV | 314 | 322 | Q9ULI2 | Ribosomal protein S6 modification-like protein B |
| 1175 | RRMsLLSVL | | | | |
| 1176 | RRMsLLSVF | | | | |
| 1177 | RRMsLLSVY | | | | |
| 1178 | RRMsLLSVM | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 169 | RRNsSERTL | 591 | 599 | P57058 | Hormonally up-regulated neu tumor-associated kinase |
| 1179 | RRNsSERTF | | | | |
| 1180 | RRNsSERTY | | | | |
| 1181 | RRNsSERTM | | | | |
| 170 | RRNsSIVGR | 436 | 444 | Q96N67 | Dedicator of cytokinesis protein 7 |
| 1182 | RRNsSIVGL | | | | |
| 1183 | RRNsSIVGF | | | | |
| 1184 | RRNsSIVGY | | | | |
| 1185 | RRNsSIVGK | | | | |
| 1186 | RRNsSIVGR | | | | |
| 171 | RRNsVFQQGM | 937 | 946 | P50993 | Na+/K+ ATPase alpha-2 subunit |
| 1187 | RRNsVFQQGK | | | | |
| 1188 | RRNsVFQQGF | | | | |
| 1189 | RRNsVFQQGY | | | | |
| 1190 | RRNsVFQQGR | | | | |
| 172 | RRPsLVHGY | 31 | 39 | P14324 | Farnesyl pyrophosphate synthase |
| 1191 | RRPsLVHGK | | | | |
| 1192 | RRPsLVHGF | | | | |
| 1193 | RRPsLVHGR | | | | |
| 173 | RRPsVFERL | 22 | 30 | Q5T200 | Zinc finger CCCH domain-containing protein 13 |
| 1194 | RRPsVFERF | | | | |
| 1195 | RRPsVFERY | | | | |
| 1196 | RRPsVFERK | | | | |
| 1197 | RRPsVFERR | | | | |
| 174 | RRPsYRKIL | 60 | 68 | P18846 | Cyclic AMP-dependent transcription factor ATF-1 |
| 1198 | RRPsYRKIF | | | | |
| 1199 | RRPsYRKIY | | | | |
| 1200 | RRPsYRKIK | | | | |
| 1201 | RRPsYRKIR | | | | |
| 175 | RRPsYTLGM | 1629 | 1637 | O43166 | Signal-induced proliferation-associated 1-like protein 1 |
| 1202 | RRPsYTLGL | | | | |
| 1203 | RRPsYTLGF | | | | |
| 1204 | RRPsYTLGY | | | | |
| 1205 | RRPsYTLGR | | | | |
| 1206 | RRPsYTLGK | | | | |
| 176 | RRSsFLQVF | 585 | 593 | Q15436 | Protein transport protein Sec23A |
| 1207 | RRSsFLQVL | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1208 | RRSsFLQVY | | | | |
| 1209 | RRSsFLQVM | | | | |
| 177 | RRSsIGLRV | 136 | 144 | Q96GN5 | Cell division cycle-associated 7-like protein |
| 1210 | RRSsIGLRL | | | | |
| 1211 | RRSsIGLRF | | | | |
| 1212 | RRSsIGLRY | | | | |
| 1213 | RRSsIGLRK | | | | |
| 1214 | RRSsIGLRR | | | | |
| 178 | RRSsIQSTF | 232 | 240 | Q92542 | Nicastrin |
| 1215 | RRSsIQSTL | | | | |
| 1216 | RRSsIQSTY | | | | |
| 1217 | RRSsIQSTK | | | | |
| 1218 | RRSsIQSTR | | | | |
| 179 | RRSsQSWSL | 29 | 37 | Q9Y4E1 | WASH complex subunit FAM21C |
| 1219 | RRSsQSWSF | | | | |
| 1220 | RRSsQSWSY | | | | |
| 1221 | RRSsQSWSK | | | | |
| 1222 | RRSsQSWSR | | | | |
| 180 | RRSsVDLGL | 61 | 69 | Q96J92 | S/T-protein kinase WNK4 |
| 1223 | RRSsVDLGF | | | | |
| 1224 | RRSsVDLGY | | | | |
| 1225 | RRSsVDLGK | | | | |
| 1226 | RRSsVDLGR | | | | |
| 181 | RRsSVDLGL | 61 | 69 | Q96J92 | S/T-protein kinase WNK4 |
| 1227 | RRsSVDLGF | | | | |
| 1228 | RRsSVDLGY | | | | |
| 1229 | RRsSVDLGK | | | | |
| 1230 | RRsSVDLGR | | | | |
| 182 | RRSsVKVEA | 512 | 520 | Q15742 | NGFI-A-binding protein 2 |
| 1231 | RRSsVKVEL | | | | |
| 1232 | RRSsVKVEF | | | | |
| 1233 | RRSsVKVEY | | | | |
| 1234 | RRSsVKVEK | | | | |
| 1235 | RRSsVKVER | | | | |
| 183 | RRVVQRSsL | 1139 | 1147 | Q04637 | Eukaryotic translation initiation factor 4 gamma 1 |
| 1236 | RRVVQRSsF | | | | |
| 1237 | RRVVQRSsY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1238 | RRVVQRSsK | | | | |
| 1239 | RRVVQRSsR | | | | |
| 184 | RRYsPPIQR | 594 | 602 | Q8IYB3 | S/R repetitive matrix protein 1 |
| 1240 | RRYsPPIQF | | | | |
| 1241 | RRYsPPIQK | | | | |
| 1242 | RRYsPPIQY | | | | |
| 1243 | RRYsPPIQR | | | | |
| 185 | SRLTHLsL | 83 | 90 | P30305 | M-phase inducer phosphatase 2 |
| 1244 | SRLTHLsF | | | | |
| 1245 | SRLTHLsY | | | | |
| 1246 | SRLTHLsK | | | | |
| 1247 | SRLTHLsR | | | | |
| 186 | SRMsPKAQR | 406 | 414 | Q8WWM7 | Ataxin-2-like protein |
| 1248 | SRMsPKAQL | | | | |
| 1249 | SRMsPKAQF | | | | |
| 1250 | SRMsPKAQY | | | | |
| 1251 | SRMsPKAQK | | | | |
| 1252 | SRTsPITRR | 1972 | 1980 | Q9UQ35 | S/R repetitive matrix protein 2 |
| 1253 | SRTsPITRL | | | | |
| 1254 | SRTsPITRF | | | | |
| 1255 | SRTsPITRY | | | | |
| 1256 | SRTsPITRK | | | | |
| 188 | SRYSRsPYSR | 168 | 177 | Q9BRL6 | Splicing factor, R/S-rich 2B |
| 1257 | SRYSRsPYSL | | | | |
| 1258 | SRYSRsPYSF | | | | |
| 1259 | SRYSRsPYSY | | | | |
| 1260 | SRYSRsPYSK | | | | |
| 189 | SRYsRSPYSR | 168 | 177 | Q9BRL6 | Splicing factor, R/S-rich 2B |
| 1261 | SRYsRSPYSL | | | | |
| 1262 | SRYsRSPYSF | | | | |
| 1263 | SRYsRSPYSY | | | | |
| 1264 | SRYsRSPYSK | | | | |
| 190 | SRYsRsPYSR | 168 | 177 | Q9BRL6 | Splicing factor, R/S-rich 2B |
| 1265 | SRYsRsPYSL | | | | |
| 1266 | SRYsRsPYSF | | | | |
| 1267 | SRYsRsPYSY | | | | |
| 1268 | SRYsRsPYSK | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| Melanoma HLA-B*1402 Phosphopeptide | | | | | |
| 191 | MRLsEWLQL | 360 | 368 | Q15051 | IQ Calmodulin-binding motif-containing protein 1 |
| 192 | RSIsVGENL | 1260 | 1268 | O60336 | Mitogen-activated protein kinase-binding protein 1 |
| 193 | RSRsPLEL | 23 | 30 | Q92466 | DNA damage-binding protein 2 |
| 194 | SPFKRQLsL | 288 | 296 | P49757 | Protein numb homolog |
| 195 | SRLTHLsL | 83 | 90 | P30305 | M-Phase inducer phosphatase 2 |
| HLA A*0301 Phosphopeptides on Transformed B-Cells | | | | | |
| 196 | ATYtPQAPK | 251 | 259 | Q53GL0 | Pleckstrin homology domain-containing family O member 1 |
| 1269 | ATYtPQAPKY | | | | |
| 1270 | ALYtPQAPK | | | | |
| 1271 | ALYtPQAPY | | | | |
| 197 | GTIRSRsFIFK | 270 | 280 | Q9JUN19 | Dual adapter for phosphotyrosine 3-phosphotyrosine and 3-phosphoinositide |
| 1272 | GTIRSRsFIFY | | | | |
| 1273 | GLIRSRsFIFK | | | | |
| 1274 | GLIRSRsFIFK | | | | |
| 1275 | GLIRSRsFIFY | | | | |
| 198 | KLPDsPALAK | 571 | 580 | Q13586 | Stromal interaction molecule 1 |
| 1276 | KLPDsPALAY | | | | |
| 1277 | KVPDsPALAK | | | | |
| 1278 | KVPDsPALAY | | | | |
| 199 | KLPDsPALAKK | 571 | 581 | Q13586 | Stromal interaction molecule 1 |
| 1279 | KLPDsPALAKY | | | | |
| 1280 | KVPDsPALAKK | | | | |
| 1281 | KVPDsPALAKY | | | | |
| 200 | KMPTtPVKAK | 47 | 56 | Q8WUA7 | TBC1 Domain family member 22A |
| 1282 | KMPTtPVKAY | | | | |
| 1283 | KLPTtPVKAK | | | | |
| 1284 | KLPTtPVKAY | | | | |
| 201 | KTPTsPLKMK | 112 | 121 | O60264 | SWI/SNF-Related matrix-assoc actin-dependent regulator of chromatin subfamily A member 5 |
| 1285 | KTPTsPLKMY | | | | |
| 1286 | KLPTsPLKMK | | | | |
| 1287 | KLPTsPLKMY | | | | |
| 1288 | KVPTsPLKMY | | | | |
| 1289 | KVPTsPLKMY | | | | |
| 202 | KVKSsPLIEKL | 79 | 89 | Q6JBY9 | CapZ-interacting protein |
| 1290 | KVKSsPLIEKY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1291 | KVKSsPLIEKK | | | | |
| 1292 | KLKSsPLIEKK | | | | |
| 1293 | KLKSsPLIEKY | | | | |
| 1294 | KMKSsPLIEKK | | | | |
| 203 | KVLtPIKEK | 365 | 373 | Q8N960 | Centrosomal protein of 120 kDa |
| 1295 | KLLtPIKEK | | | | |
| 1296 | KLLtPIKEY | | | | |
| 1297 | KVLtPIKEY | | | | |
| 204 | RAKsPISLK | 509 | 517 | Q9BXL7 | Caspase recruitment domain-containing protein 1 |
| 1298 | RAKsPISLY | | | | |
| 1299 | RLKsPISLK | | | | |
| 1300 | RLKsPISLY | | | | |
| 1301 | RVKsPISLK | | | | |
| 205 | RILsGVVTK | 71 | 79 | P62280 | 40S Ribosomal protein S11 |
| 1302 | RILsGVVTY | | | | |
| 1303 | RLLsGVVTK | | | | |
| 1304 | RVLsGVVTK | | | | |
| 1305 | RLLsGVVTY | | | | |
| 206 | RIYQyIQSR | 269 | 277 | Q9Y463 | Dual specificity tyrosine-phosphorylation-regulated kinase 1B |
| 1306 | RVYQyIQSR | | | | |
| 1307 | RMYQyIQSR | | | | |
| 1308 | RIYQyIQSK | | | | |
| 1309 | RIYQyIQSY | | | | |
| 1310 | RLYQyIQSK | | | | |
| 1311 | RLYQyIQSY | | | | |
| 207 | RIYQyIQSRF | 269 | 278 | Q9Y463 | Dual specificity tyrosine-phosphorylation-regulated kinase 1B |
| 1312 | RIYQyIQSRY | | | | |
| 1313 | RIYQyIQSRK | | | | |
| 1314 | RVYQyIQSRK | | | | |
| 1315 | RVYQyIQSRY | | | | |
| 208 | RIYQyIQSRFY | 269 | 279 | Q9Y463 | Dual specificity tyrosine-phosphorylation-regulated kinase 1B |
| 1316 | RIYQyIQSRFK | | | | |
| 1317 | RLYQyIQSRFY | | | | |
| 1318 | RVYQyIQSRFY | | | | |
| 1319 | RVYQyIQSRFK | | | | |
| 1320 | RLYQyIQSRFK | | | | |
| 209 | RLLDRSPsRSAK | 301 | 312 | Q76039 | Cyclin-dependent kinase-like 5 |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
| --- | --- | --- | --- | --- | --- |
| 1321 | RLLDRSPsRSAY | | | | |
| 1322 | RMLDRSPsRSAK | | | | |
| 1323 | RMLDRSPsRSAY | | | | |
| 1324 | RVLDRSPsRSAK | | | | |
| 1325 | RVLDRSPsRSAY | | | | |
| 210 | RLPsSTLKR | 813 | 821 | Q86Y91 | Kinesin-like protein KIF18B |
| 1326 | RLPsSTLKK | | | | |
| 1327 | RLPsSTLKY | | | | |
| 1328 | RVPsSTLKK | | | | |
| 1329 | RVPsSTLKY | | | | |
| 211 | RLSsPISKR | 327 | 335 | Q99728 | BRCA1-Associated ring domain protein 1 |
| 1330 | RLSsPISKK | | | | |
| 1331 | RLSsPISKY | | | | |
| 1332 | RVSsPISKK | | | | |
| 1333 | RVSsPISKY | | | | |
| 212 | RQAsPLVHR | 161 | 169 | Q9UGI6 | Small conductance calcium-activated potassium channel protein 3 |
| 1334 | RQAsPLVHK | | | | |
| 1335 | RQAsPLVHY | | | | |
| 1336 | RLAsPLVHK | | | | |
| 1337 | RLAsPLVHY | | | | |
| 1338 | RVAsPLVHK | | | | |
| 1339 | RVAsPLVHY | | | | |
| 213 | RSVsLSMRK | 163 | 171 | O60238 | BLC2/Adenovirus E1B 19 kDa protein-interacting protein 3-like |
| 1340 | RSVsLSMRY | | | | |
| 1341 | RLVsLSMRK | | | | |
| 1342 | RVVsLSMRK | | | | |
| 1343 | RVVsLSMRY | | | | |
| 1344 | RLVsLSMRY | | | | |
| 1345 | RMVsLSMRK | | | | |
| 1346 | RMVsLSMRY | | | | |
| 214 | RSYSRsFSR | 713 | 721 | Q7Z6E9 | E3 Ubiquitin-protein ligase RBBP6 |
| 1347 | RSYSRsFSK | | | | |
| 1348 | RSYSRsFSY | | | | |
| 1349 | RLYSRsFSK | | | | |
| 1350 | RLYSRsFSY | | | | |
| 1351 | RVYSRsFSK | | | | |
| 1352 | RVYSRsFSY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 215 | RTAsFAVRK | 249 | 248 | Q9Y512 | Sorting and assembly machinery component 50 homolog |
| 1353 | RTAsFAVRY | | | | |
| 1354 | RVAsFAVRK | | | | |
| 1355 | RLAsFAVRK | | | | |
| 1356 | RLAsFAVRY | | | | |
| 1357 | RVAsFAVRY | | | | |
| 216 | RTAsPPPPPK | 613 | 622 | Q8IYB3 | A/R Repetitive matrix protein 1 |
| 1358 | RVAsPPPPPK | | | | |
| 1359 | RLAsPPPPPK | | | | |
| 1360 | RVAsPPPPPY | | | | |
| 1361 | RLAsPPPPPY | | | | |
| 1362 | RMAsPPPPPK | | | | |
| 217 | RTRsLSSLREK | 1975 | 1985 | O94915 | Protein fury homolog-like |
| 1363 | RVRsLSSLREK | | | | |
| 1364 | RMRsLSSLREK | | | | |
| 1365 | RLRsLSSLREK | | | | |
| 1366 | RTRsLSSLREY | | | | |
| 1367 | RVRsLSSLREY | | | | |
| 218 | RVRQsPLATR | 40 | 49 | O75381 | Peroxisomal membrane protein PEX14 |
| 1368 | RVRQsPLATK | | | | |
| 1369 | RVRQsPLATY | | | | |
| 1370 | RLRQsPLATR | | | | |
| 1371 | RLRQsPLATY | | | | |
| 1372 | RLRQsPLATK | | | | |
| 219 | RVSsRFSSR | 48 | 56 | Q9BUV0 | UPF0471 protein C1orf63 |
| 1373 | RVSsRFSSK | | | | |
| 1374 | RVSsRFSSY | | | | |
| 1375 | RLSsRFSSR | | | | |
| 1376 | RLSsRFSSK | | | | |
| 1377 | RLSsRFSSY | | | | |
| 220 | RVSsVKLISK | 259 | 268 | P30559 | Oxytocin receptor |
| 1378 | RVSsVKLISY | | | | |
| 1379 | RLSsVKLISK | | | | |
| 1380 | RLSsVKLISY | | | | |
| 1381 | RMSsVKLISK | | | | |
| 1382 | RMSsVKLISY | | | | |
| 221 | RVYsPYNHR | 582 | 590 | Q9NS56 | E3 Ubiquitin-protein Topors |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1383 | RVYsPYNHK | | | | |
| 1384 | RVYsPYNHY | | | | |
| 1385 | RLYsPYNHK | | | | |
| 1386 | RLYsPYNHY | | | | |
| 222 | SVRRsVLMK | 223 | 231 | Q9H2J4 | Phosducin-like protein 3 |
| 1387 | SVRRsVLMY | | | | |
| 1388 | SLRRsVLMK | | | | |
| 1389 | SLRRsVLMY | | | | |
| 1390 | SMRRsVLMK | | | | |

HLA B*0702 Phosphopeptides on Transformed B-Cells

| SEQ ID No. | Sequence | Start | Stop | UniProt | Source Protein |
|---|---|---|---|---|---|
| 223 | GPRPGsPSAL | 276 | 286 | Q9UJJ7 | RNA pseudouridylate synthase domain-containing protein 1 |
| 1391 | GPRPGsPSAV | | | | |
| 1392 | GPRPGsPSAM | | | | |
| 1393 | GPRPGsPSAF | | | | |
| 224 | HPRsPNVLSV | 684 | 693 | Q16665 | Hypoxia-inducible factor 1-alpha |
| 1394 | HPRsPNVLSL | | | | |
| 1395 | HPRsPNVLSM | | | | |
| 1396 | HPRsPNVLSF | | | | |
| 225 | KPRsPPRAL | 249 | 257 | Q86TG7 | Retrotransposon-derived protein PEG10 |
| 1397 | KPRsPPRAV | | | | |
| 1398 | KPRsPPRAM | | | | |
| 1399 | KPRsPPRAF | | | | |
| 226 | KPRsPPRALVL | 249 | 259 | Q86TG7 | Retrotransposon-derived protein PEG10 |
| 1400 | KPRsPPRALVV | | | | |
| 1401 | KPRsPPRALVM | | | | |
| 1402 | KPRsPPRALVF | | | | |
| 227 | KPRsPPRALVLP | 249 | 260 | Q86TG7 | Retrotransposon-derived protein PEG10 |
| 1403 | KPRsPPRALVLV | | | | |
| 1404 | KPRsPPRALVLL | | | | |
| 1405 | KPRsPPRALVLM | | | | |
| 1406 | KPRsPPRALVLF | | | | |
| 228 | KPRsPVVEL | 667 | 675 | P25098 | Beta-adrenergic receptor Kinase 1 |
| 1407 | KPRsPVVEV | | | | |
| 1408 | KPRsPVVEM | | | | |
| 1409 | KPRsPVVEF | | | | |
| 229 | LPAsPHQL | 998 | 1005 | Q8TEK3 | Histone lysine (H3-K79) N-methyl transferase |
| 1410 | LPAsPHQV | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1411 | LPAsPHQM | | | | |
| 1412 | LPAsPHQF | | | | |
| 230 | LPIFSRLsI | 483 | 491 | P47974 | Zince finger protein 36, C3H1 type-like 2 |
| 1413 | LPIFSRLsV | | | | |
| 1414 | LPIFSRLsL | | | | |
| 1415 | LPIFSRLsM | | | | |
| 1416 | LPIFSRLsF | | | | |
| 231 | LPKsPPYTAF | 90 | 99 | P23588 | Eukaryotic translation initiation factor 4B |
| 1417 | LPKsPPYTAV | | | | |
| 1418 | LPKsPPYTAL | | | | |
| 1419 | LPKsPPYTAM | | | | |
| 232 | MPRQPsATRL | 134 | 143 | Q6NZ67 | Mitotic-spindle organizing protein 2B |
| 1420 | MPRQPsATRV | | | | |
| 1421 | MPRQPsATRM | | | | |
| 1422 | MPRQPsATRF | | | | |
| 233 | RPAsAGAML | 198 | 2006 | Q14814 | Myocyte-specific enhancer factor 2D |
| 1423 | RPAsAGAMV | | | | |
| 1424 | RPAsAGAMM | | | | |
| 1425 | RPAsAGAMF | | | | |
| 234 | RPKsNIVLL | 222 | 230 | P11836 | B-Lymphocyte antigen CD20 |
| 1426 | RPKsNIVLV | | | | |
| 1427 | RPKsNIVLM | | | | |
| 1428 | RPKsNIVLF | | | | |
| 235 | RPNsPSPTAL | 185 | 194 | Q9UK18 | S/T-Protein kinase tousled-like 1 |
| 1429 | RPNsPSPTAV | | | | |
| 1430 | RPNsPSPTAM | | | | |
| 1431 | RPNsPSPTAF | | | | |
| 236 | RPRsISVEEF | 1143 | 1152 | Q7Z333 | Probably helicase senataxin |
| 1432 | RPRsISVEEV | | | | |
| 1433 | RPRsISVEEL | | | | |
| 1434 | RPRsISVEEM | | | | |
| 237 | RPRsPPPRAP | 499 | 508 | O43900 | Prickle-like protein 3 |
| 1435 | RPRsPPPRAV | | | | |
| 1436 | RPRsPPPRAL | | | | |
| 1437 | RPRsPPPRAF | | | | |
| 1438 | RPRsPPPRAM | | | | |
| 238 | RPRsPRQNSI | 689 | 698 | Q99700 | Ataxin-2 |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1439 | RPRsPRQNSV | | | | |
| 1440 | RPRsPRQNLI | | | | |
| 1441 | RPRsPRQNSM | | | | |
| 1442 | RPRsPRQNSF | | | | |
| 239 | RPRPVsPSSL | 430 | 439 | P57059 | Serine/threonine-protein kinase SIK1 |
| 1443 | RPRPVsPSSV | | | | |
| 1444 | RPRPVsPSSM | | | | |
| 1445 | RPRPVsPSSF | | | | |
| 240 | RPYsPPFFSL | 187 | 196 | Q9NYF3 | Protein FAM53C |
| 1446 | RPYsPPFFSV | | | | |
| 1447 | RPYsPPFFSM | | | | |
| 1448 | RPYsPPFFSF | | | | |
| 241 | SPGsPRPAL | 391 | 399 | Q9H211 | DNA Replication factor Cdt1 |
| 1449 | SPGsPRPAV | | | | |
| 1450 | SPGsPRPAF | | | | |
| 1451 | SPGsPRPAM | | | | |
| 242 | SPRRsRSISL | 159 | 168 | Q16629 | S/R-Rich splicing factor 7 |
| 1452 | SPRRsRSISV | | | | |
| 1453 | SPRRsRSISM | | | | |
| 1454 | SPRRsRSISF | | | | |
| 243 | SPRsPSTTYL | 772 | 781 | Q13111 | Chromatin assembly factor 1 subunit A |
| 1455 | SPRsPSTTYV | | | | |
| 1456 | SPRsPSTTYM | | | | |
| 1457 | SPRsPSTTYF | | | | |
| 244 | VPREVLRLsL | 1162 | 1171 | Q7Z591 | AT-Hook-containing transcription factor |
| 1458 | VPREVLRLsV | | | | |
| 1459 | VPREVLRLsM | | | | |
| 1460 | VPREVLRLsF | | | | |

HLA A*0101 Phosphopeptides on Transformed B-Cells

| SEQ ID No. | Sequence | Start | Stop | UniProt | Source Protein |
|---|---|---|---|---|---|
| 245 | ITQGtLKY | 1459 | 1467 | Q9Y618 | Nuclear receptor corepressor 2 |
| 1461 | ITDGtLKY | | | | |
| 1462 | ITEGtLKY | | | | |
| 1463 | ISDGtLKY | | | | |
| 1464 | ISEGtLKY | | | | |
| 246 | NTDsPLRY | 149 | 156 | P08865 | 40S Ribosomal protein SA |
| 1465 | NTEsPLRY | | | | |
| 1466 | NSDsPLRY | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1467 | NSEsPLRY | | | | |
| 247 | QLDsPQRALY | 59 | 68 | Q16587 | Zinc finger protein 74 |
| 1468 | QTDsPQRALY | | | | |
| 1469 | QSDsPQRALY | | | | |
| 1470 | QLEsPQRALY | | | | |
| 1471 | QTEsPQRALY | | | | |
| 1472 | QSEsPQRALY | | | | |

HLA B*2705 Phosphopeptides on Transformed B-Cells

| SEQ ID No. | Sequence | Start | Stop | UniProt | Source Protein |
|---|---|---|---|---|---|
| 249 | HRLsPVKGEF | 367 | 376 | Q9Y2L9 | Leucine-rich repeat and calponin homology domain-containing protein 1 |
| 1473 | HRLsPVKGEK | | | | |
| 1474 | HRLsPVKGEY | | | | |
| 1475 | HRLsPVKGER | | | | |
| 250 | KRFsFKKSF | 156 | 164 | P29966 | Myristoylated A-rich C-kinase substrate |
| 1476 | KRFsFKKSK | | | | |
| 1477 | KRFsFKKSY | | | | |
| 1478 | KRFsFKKSR | | | | |
| 251 | KRLsPAPQL | 51 | 59 | Q9UH99 | SUN domain-containing protein 2 |
| 1479 | KRLsPAPQF | | | | |
| 1480 | KRLsPAPQK | | | | |
| 1481 | KRLsPAPQY | | | | |
| 1482 | KRLsPAPQR | | | | |
| 252 | KRMsPKEL | 17 | 25 | P41208 | Centrin-2 |
| 1483 | KRMsPKEF | | | | |
| 1484 | KRMsPKEK | | | | |
| 1485 | KRMsPKEY | | | | |
| 1486 | KRMsPKER | | | | |
| 253 | RRAsLSEIGF | 177 | 186 | Q00537 | Cyclin-dependent kinase 17 |
| 1487 | RRAsLSEIGY | | | | |
| 1488 | RRAsLSEIGK | | | | |
| 1489 | RRAsLSEIGF | | | | |
| 254 | RRDsIVAEL | 96 | 104 | O14579 | Coatomer subunit epsilon |
| 1490 | RRDsIVAEF | | | | |
| 1491 | RRDsIVAEY | | | | |
| 1492 | RRDsIVAEK | | | | |
| 1493 | RRDsIVAER | | | | |
| 255 | RRFtPPSPAF | 11 | 20 | Q13761 | Runt-related transcription factor 3 |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 1494 | RRFtPPSPAY | | | | |
| 1495 | RRFtPPSPAK | | | | |
| 1496 | RRFtPPSPAR | | | | |
| 256 | RRFsRSPIR | 2026 | 2034 | P18583 | SON3, DNA-binding protein 5, BASS1 |
| 1497 | RRFsRSPK | | | | |
| 1498 | RRFsRSPIF | | | | |
| 1499 | RRFsRSPIY | | | | |
| 257 | RRFsRsPIR | 2026 | 2034 | P18583 | SON3, DNA-binding protein 5, BASS1 |
| 1500 | RRFsRsPIK | | | | |
| 1501 | RRFsRsPIF | | | | |
| 1502 | RRFsRsPIY | | | | |
| 253 | RRFsRsPIRR | 2026 | 2034 | P18583 | SON3, DNA-binding protein 5, BASS1 |
| 1504 | RRFsRsPIRY | | | | |
| 1505 | RRFsRsPIRF | | | | |
| 1506 | RRFsRsPIRK | | | | |
| 259 | RRIDIsPSTF | 677 | 686 | Q9Y2W1 | Thyroid hormone receptor-associated protein 3 |
| 1506 | RRIDIsPSTY | | | | |
| 1507 | RRIDIsPSTK | | | | |
| 1508 | RRIDIsPSTR | | | | |
| 260 | RRIsGVDRYY | 52 | 60 | O15239 | NADH dehydrogenase (ubiquinone) 1 α subcomplex subunit 1 |
| 1509 | RRIsGVDRYF | | | | |
| 1510 | RRIsGVDRYK | | | | |
| 1511 | RRIsGVDRYR | | | | |
| 261 | RRLsNLPTV | 36 | 44 | Q86U86 | Protein polybromo 1 |
| 1512 | RRLsNLPTF | | | | |
| 1513 | RRLsNLPTY | | | | |
| 1514 | RRLsNLPTK | | | | |
| 1515 | RRLsNLPTR | | | | |
| 262 | RRMsLLSVV | 314 | 322 | Q9ULI2 | Beta-citryl-glutamate synthase B |
| 1516 | RRMsLLSVF | | | | |
| 1517 | RRMsLLSVY | | | | |
| 1518 | RRMsLLSVK | | | | |
| 1519 | RRMsLLSVR | | | | |
| 263 | RRYsPPIQR | 594 | 602 | Q8IYB3 | S/R repetitive matrix protein 1 |
| 1520 | RRYsPPIQF | | | | |
| 1521 | RRYsPPIQY | | | | |
| 1522 | RRYsPPIQK | | | | |

TABLE 16-continued

Phosphopeptides Presented in Association with Class I MHC Molecules on Cancer Cells with Sequence Variations for Use in Immunotherapy

| SEQ ID No. | Sequence | Start | Stop | UniProt | Source Protein |
|---|---|---|---|---|---|
| 264 | SRWsGSHQF | 602 | 610 | P15056 | BRAF/serine/threonine-protein kinase B-raf |
| 1523 | SRWsGSHQY | | | | |
| 1524 | SRWsGSHQK | | | | |
| 1525 | SRWsGSHQR | | | | |
| 265 | TRLsPAKIVLR | 772 | 782 | Q8TEK3 | Histone-lysine N-methyltransferase, H3 lysine-79 specific |
| 1526 | TRLsPAKIVLK | | | | |
| 1527 | TRLsPAKIVLF | | | | |
| 1528 | TRLsPAKIVLY | | | | |

Column 2: Phosphopeptide sequences; pSer, pThr and pTyr are specified by s, t, and y, respectively.
Column 3 & 4: Entries define the location of the phosphopeptides within the sequence of the parent protein.
Column 5: Protein identifier in the UniProt database, www[dot]uniprot[dot]org
Column 6: Name of the protein in the UniProt database.

TABLE 17

Phosphopeptides Presented in Association with Class I Molecules on Cancer Cells with Sequence Variations for Use in Immunotherapy: Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 266 | APRKGsFSALM | 5 | 14 | M | Q13619 | Cullin-4A |
| 1529 | APRKGsFSALF | | | | | |
| 1530 | APRKGsFSALL | | | | | |
| 1531 | APRKGsFSALV | | | | | |
| 267 | APRRYsSSL | 697 | 705 | L/M | Q68EM7 | Rho GTPase-activating protein 17 |
| 1532 | APRRYsSSF | | | | | |
| 1533 | APRRYsSSV | | | | | |
| 1534 | APRRYsSSM | | | | | |
| 268 | APRsPPPSRP | 8 | 17 | M | Q9NSA8 | SOCS-1/Suppressor of cytokine signaling protein |
| 1535 | APRsPPPSRV | | | | | |
| 1536 | APRsPPPSRL | | | | | |
| 1537 | APRsPPPSRF | | | | | |
| 1538 | APRsPPPSRM | | | | | |
| 269 | EPKRRsARL | 15 | 23 | L | P82970 | Nucleosome-binding domain-containing protein 5 |
| 1539 | EPKRRsARV | | | | | |
| 1540 | EPKRRsARM | | | | | |
| 1541 | EPKRRsARF | | | | | |
| 270 | EPRsPSHSM | 746 | 754 | L | Q03164 | Histone-lysine N-methyltransferase MLL |
| 1542 | EPRsPSHSL | | | | | |
| 1543 | EPRsPSHSV | | | | | |
| 1544 | EPRsPSHSF | | | | | |

TABLE 17-continued

Phosphopeptides Presented in Association with Class I Molecules on Cancer Cells with Sequence Variations for Use in Immunotherapy: Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 271 | FPHsLLSVI | 662 | 670 | M | Q9H9Y6 | DNA-directed RNA polymerase I 135 kDa polypeptides/POLR1B |
| 1545 | FPHsLLSVV | | | | | |
| 1546 | FPHsLLSVL | | | | | |
| 1547 | FPHsLLSVF | | | | | |
| 1548 | FPHsLLSVM | | | | | |
| 272 | FRRsPTKSSL | 624 | 633 | L | Q96PK6 | RNA-binding protein 14 |
| 1549 | FRRsPTKSSV | | | | | |
| 1550 | FRRsPTKSSM | | | | | |
| 1551 | FRRsPTKSSF | | | | | |
| 1552 | FPRsPTKSSL | | | | | |
| 1553 | FPRsPTKSSV | | | | | |
| 1554 | FPRsPTKSSM | | | | | |
| 1555 | FPRsPTKSSF | | | | | |
| 273 | FRRsPTKSSLDY | 624 | 635 | L | Q96PK6 | RNA-binding protein 14 |
| 1556 | FRRsPTKSSLDL | | | | | |
| 1557 | FRRsPTKSSLDV | | | | | |
| 1558 | FRRsPTKSSLDF | | | | | |
| 1559 | FRRsPTKSSLDM | | | | | |
| 1560 | FPRsPTKSSLDL | | | | | |
| 1561 | FPRsPTKSSLDV | | | | | |
| 1562 | FPRsPTKSSLDM | | | | | |
| 1563 | FPRsPTKSSLDF | | | | | |
| 274 | FSIsPVRL | 2010 | 2017 | L | P18583 | Protein SON |
| 1564 | FSIsPVRV | | | | | |
| 1565 | FSIsPVRM | | | | | |
| 1566 | FSIsPVRF | | | | | |
| 1567 | FPIsPVRL | | | | | |
| 1568 | FPIsPVRV | | | | | |
| 1569 | FPIsPVRM | | | | | |
| 1570 | FPIsPVRF | | | | | |
| 275 | GAQPGRHsV | 256 | 264 | M | Q96IF1 | Ajuba (a novel LIM protein required for mitotic commitment) |
| 1571 | GAQPGRHsF | | | | | |
| 1572 | GAQPGRHsL | | | | | |
| 1573 | GPQPGRHsV | | | | | |
| 1574 | GPQPGRHsF | | | | | |
| 1575 | GPQPGRHsL | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 276 | GPRSAsLLsL | 51 | 60 | L | Q9Y4H4 | G-protein-signaling modulator 3 |
| 1576 | GPRSAsLLsV | | | | | |
| 1577 | GPRSAsLLsF | | | | | |
| 1578 | GPRSAsLLsM | | | | | |
| 277 | GPRSASLLsL | 51 | 60 | M | Q9Y4H4 | G-protein-signaling modulator 3 |
| 1579 | GPRSASLLsV | | | | | |
| 1580 | GPRSASLLsF | | | | | |
| 1581 | GPRSASLLsM | | | | | |
| 278 | GPRsASLLSL | 51 | 60 | M | Q9Y4H4 | G-protein-signaling modulator 3 |
| 1582 | GPRsASLLSV | | | | | |
| 1583 | GPRsASLLSF | | | | | |
| 1584 | GPRsASLLSM | | | | | |
| 279 | HPRsPTPTL | 341 | 349 | M | Q96HE9 | Proline rich protein 11 |
| 1585 | HPsSPTPTV | | | | | |
| 1586 | HPRsPTPTF | | | | | |
| 1587 | HPRsPTPTM | | | | | |
| 280 | HPRSPtPTL | 341 | 349 | M | Q96HE9 | Proline rich protein 11 |
| 1588 | HPRSPtPTV | | | | | |
| 1589 | HPRSPtPTF | | | | | |
| 1590 | HPRSPtPTM | | | | | |
| 281 | KARsPGRAL | 6 | 14 | M | Q14767 | Latent transforming growth factor-beta-binding protein-2 |
| 1591 | KARsPGRAV | | | | | |
| 1592 | KARsPGRAF | | | | | |
| 1593 | KARsPGRAM | | | | | |
| 282 | KPAsPARRL | 2614 | 2622 | L | P78559 | Microtubule associated protein 1 (MAP1) |
| 1594 | KPAsPARRV | | | | | |
| 1595 | KPAsPARRF | | | | | |
| 1596 | KPAsPARRM | | | | | |
| 283 | KPAsPKFIVTL | 512 | 522 | L | Q6PJT7 | Zinc finger CCCH domain-containing protein 14 |
| 1597 | KPAsPKFIVTV | | | | | |
| 1598 | KPAsPKFIVTF | | | | | |
| 1599 | KPAsPKFIVTM | | | | | |
| 284 | KPPHsPLVL | 289 | 297 | L | P01106 | Myc proto-oncogene protein |
| 1600 | KPPHsPLVM | | | | | |
| 1601 | KPPHsPLVV | | | | | |
| 1602 | KPPHsPLVF | | | | | |
| 285 | KPPsPEHQSL | 653 | 662 | L | Q9Y6X9 | MORC family CW-type zinc finger protein 2 |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1603 | KPPsPEHQSV | | | | | |
| 1604 | KPPsPEHQSF | | | | | |
| 1605 | KPPsPEHQSM | | | | | |
| 286 | KPPsPSPIEM | 83 | 92 | L | Q9H165 | B-cell lymphoma/leukemia 11A |
| 1606 | KPPsPSPIEL | | | | | |
| 1607 | KPPsPSPIEV | | | | | |
| 1608 | KPPsPSPIEF | | | | | |
| 287 | KPPtPGASF | 1734 | 1742 | L | Q96T58 | Msx2-interacting protein |
| 1609 | KPPtPGASL | | | | | |
| 1610 | KPPtPGASV | | | | | |
| 1611 | KPPtPGASM | | | | | |
| 288 | KPPYRSHsL | 442 | 450 | L | Q96GE4 | Coiled-coil domain-containing protein 45 |
| 1612 | KPPYRSHsV | | | | | |
| 1613 | KPPYRSHsF | | | | | |
| 1614 | KPPYRSHsM | | | | | |
| 289 | KPQTRGKtF | 408 | 416 | L | Q8IV04 | Carabin |
| 1615 | KPQTRGKtL | | | | | |
| 1616 | KPQTRGKtV | | | | | |
| 1617 | KPQTRGKtM | | | | | |
| 290 | KPRPPPLsP | 328 | 336 | M | Q15162 | Cdc42-interacting protein 4 |
| 1618 | KPRPPPLsL | | | | | |
| 1619 | KPRPPPLsV | | | | | |
| 1620 | KPRPPPLsF | | | | | |
| 1621 | KPRPPPLsM | | | | | |
| 291 | KPRsPDHVL | 859 | 867 | L | Q9UPN3 | Microtubule-actin cross-linking factor 1 |
| 1622 | KPRsPDHVV | | | | | |
| 1623 | KPRsPDHVF | | | | | |
| 1624 | KPRsPDHVM | | | | | |
| 292 | KPRsPPRAL | 249 | 257 | L/M | Q86TG8 | Retrotransposon-derived protein PEG11 |
| 1625 | KPRsPPRAV | | | | | |
| 1626 | KPRsPPRAF | | | | | |
| 1627 | KPRsPPRAM | | | | | |
| 293 | KPRsPPRALV | 249 | 258 | M | Q86TG8 | Retrotransposon-derived protein PEG11 |
| 1628 | KPRsPPRALM | | | | | |
| 1629 | KPRsPPRALL | | | | | |
| 1630 | KPRsPPRALF | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 294 | KPRsPPRALVL | 249 | 259 | M | Q86TG9 | Retrotransposon-derived protein PEG12 |
| 1631 | KPRsPPRALVV | | | | | |
| 1632 | KPRsPPRALVF | | | | | |
| 1633 | KPRsPPRALVM | | | | | |
| 295 | KPRsPVVEL | 667 | 675 | L/M | P25098 | Beta-Adrenergic receptor kinase 1 |
| 1634 | KPRsPVVEV | | | | | |
| 1635 | KPRsPVVEF | | | | | |
| 1636 | KPRsPVVEM | | | | | |
| 296 | KPYsPLASL | 70 | 78 | L | Q13469 | Nuclear factor of activated T-cells, cytoplasmic 2 |
| 1637 | KPYsPLASV | | | | | |
| 1638 | KPYsPLASF | | | | | |
| 1639 | KPYsPLASM | | | | | |
| 297 | LPAsPRARL | 443 | 451 | L | Q3KQU3 | Map 7 domain-containing protein 1 |
| 1640 | LPAsPRARV | | | | | |
| 1641 | LPAsPRARF | | | | | |
| 1642 | LPAsPRARM | | | | | |
| 298 | LPIFSRLsI | 483 | 491 | L | P47974 | Zinc finger protein 36, C3H1 type-like 2 |
| 1643 | LPIFSRLsL | | | | | |
| 1644 | LPIFSRLsV | | | | | |
| 1645 | LPIFSRLsF | | | | | |
| 1646 | LPIFSRLsM | | | | | |
| 299 | LPKsPPYTAF | 90 | 99 | M | P23588 | Eukaryotic translation initiation factor 4B |
| 1647 | LPKsPPYTAV | | | | | |
| 1648 | LPKsPPYTAL | | | | | |
| 1649 | LPKsPPYTAM | | | | | |
| 300 | LPRGSsPSVL | 105 | 114 | M | Q9GZN2 | TGF-beta-induced transcription factor 2 |
| 1650 | LPRGSsPSVV | | | | | |
| 1651 | LPRGSsPSVF | | | | | |
| 1652 | LPRGSsPSVM | | | | | |
| 301 | MPRQPsATRL | 134 | 143 | M | Q6P582 | Mitotic-spindle organizing protein 2A |
| 1653 | MPRQPsATRV | | | | | |
| 1654 | MPRQPsATRF | | | | | |
| 1655 | MPRQPsATRM | | | | | |
| 302 | QPRsPGPDYSL | 17 | 27 | L | Q99684 | Zinc finger protein Gfi-1 |
| 1656 | QPRsPGPDYSV | | | | | |
| 1657 | QPRsPGPDYSF | | | | | |
| 1658 | QPRsPGPDYSM | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 303 | QPRtPsPLVL | 172 | 181 | L | P33241 | Lymphocyte-specific protein 1 |
| 1659 | QPRtPsPLVV | | | | | |
| 1660 | QPRtPsPLVF | | | | | |
| 1661 | QPRtPsPLVM | | | | | |
| 304 | QPRtPSPLVL | 172 | 181 | L | P33241 | Lymphocyte-specific protein 1 |
| 1662 | QPRtPSPLVV | | | | | |
| 1663 | QPRtPSPLVF | | | | | |
| 1664 | QPRtPSPLVM | | | | | |
| 305 | RAPsPSSRM | 2423 | 2431 | L | Q9UQ35 | Serine/arginine repetitive matrix protein 2 |
| 1665 | RAPsPSSRL | | | | | |
| 1666 | RAPsPSSRV | | | | | |
| 1667 | RAPsPSSRF | | | | | |
| 1668 | RPPsPSSRM | | | | | |
| 1669 | RPPsPSSRL | | | | | |
| 1670 | RPPsPSSRV | | | | | |
| 1671 | RPPsPSSRF | | | | | |
| 306 | RPAKsMDSL | 323 | 331 | L | Q7Z6I6 | Rho GTPase-activating protein 30 |
| 1672 | RPAKsMDV | | | | | |
| 1673 | RPAKsMDSF | | | | | |
| 1674 | RPAKsMDSM | | | | | |
| 307 | RPAsAGAML | 198 | 206 | L | Q14814 | Monocyte-specific enhancer factor 2D |
| 1675 | RPAsAGAMV | | | | | |
| 1676 | RPAsAGAMF | | | | | |
| 1677 | RPAsAGAMM | | | | | |
| 308 | RPAsARAQPGL | 57 | 67 | L/M | Q9NPB0 | Uncharacterized protein C6orf64 |
| 1678 | RPAsARAQPGV | | | | | |
| 1679 | RPAsARAQPGF | | | | | |
| 1680 | RPAsARAQPGM | | | | | |
| 309 | RPAsPAAKL | 512 | 520 | M | Q9P2N6 | KIAA1310 |
| 1681 | RPAsPAAKV | | | | | |
| 1682 | RPAsPAAKF | | | | | |
| 1683 | RPAsPAAKM | | | | | |
| 310 | RPAtGGPGVA | 71 | 80 | L | Q86TW6 | Unknown protein |
| 1684 | RPAtGGPGVL | | | | | |
| 1685 | RPAtGGPGVV | | | | | |
| 1686 | RPAtGGPGVF | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1687 | RPAtGGPGVM | | | | | |
| 311 | RPAtPTSQF | | | M | | Unknown protein |
| 1688 | RPAtPTSQV | | | | | |
| 1689 | RPAtPTSQL | | | | | |
| 1690 | RPAtPTSQM | | | | | |
| 312 | RPDsRLGKTEL | 1225 | 1235 | L | Q9BYW2 | Histone-lysine N-methyltransferase, SETD2 |
| 1691 | RPDsRLGKTEV | | | | | |
| 1692 | RPDsRLGKTEF | | | | | |
| 1694 | RPDsRLGKTEM | | | | | |
| 313 | RPFsPREAL | 742 | 750 | L | Q86V48 | Leucine zipper protein 1 |
| 1694 | RPFsPREAV | | | | | |
| 1695 | RPFsPREAM | | | | | |
| 1696 | RPFsPREAF | | | | | |
| 314 | RPHsPEKAF | 497 | 505 | L | Q53F19 | Uncharacterized protein C17orf85 |
| 1697 | RPHsPEKAL | | | | | |
| 1698 | RPHsPEKAV | | | | | |
| 1699 | RPHsPEKAM | | | | | |
| 315 | RPItPPRNSA | 317 | 326 | L | P62136 | Ser/Thr-protein phosphatase PP1-alpha, catalytic subunit |
| 1700 | RPItPPRNSL | | | | | |
| 1701 | RPItPPRNSV | | | | | |
| 1702 | RPItPPRNSF | | | | | |
| 1703 | RPItPPRNSM | | | | | |
| 316 | RPIsPGLSY | 364 | 372 | L | Q16204 | Coiled-coil domain containing protein 6 |
| 1704 | RPIsPGLSL | | | | | |
| 1705 | RPIsPGLSV | | | | | |
| 1706 | RPIsPGLSF | | | | | |
| 1707 | RPIsPGLSM | | | | | |
| 317 | RPKLSsPAL | 15 | 23 | L | Q09472 | Histone acetyltransferase p300 |
| 1708 | RPKLSsPAV | | | | | |
| 1709 | RPKLSsPAF | | | | | |
| 1710 | RPKLSsPAM | | | | | |
| 318 | RPKPSSsPV | 183 | 191 | L | Q15366 | roly(rC)-binding protein 2 |
| 1711 | RPKPSSsPL | | | | | |
| 1712 | RPKPSSsPF | | | | | |
| 1713 | RPKPSSsPM | | | | | |
| 319 | RPNsPSPTAL | 185 | 194 | L | Q9UKI8 | Serine/threonine-protein kinase tousled-like 1 |
| 1714 | RPNsPSPTAV | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1715 | RPNsPSPTAF | | | | | |
| 1716 | RPNsPSPTAM | | | | | |
| 320 | RPPPPPDtPP | 166 | 175 | L | Q9Y5W3 | Krueppel-like factor 2 |
| 1717 | RPPPPPDtPL | | | | | |
| 1718 | RPPPPPDtPV | | | | | |
| 1719 | RPPPPPDtPF | | | | | |
| 1720 | RPPPPPDtPM | | | | | |
| 321 | RPPsPGPVL | 934 | 942 | L | Q12770 | SREPB cleavage-activating protein |
| 1721 | RPPsPGPVV | | | | | |
| 1722 | RPPsPGPVF | | | | | |
| 1723 | RPPsPGPVM | | | | | |
| 322 | RPPsSEFLDL | 476 | 485 | L | Q9P2R6 | Arginine-glutamic acid dipeptide repeats protein |
| 1724 | RPPsSEFLDV | | | | | |
| 1725 | RPPsSEFLDF | | | | | |
| 1726 | RPPsSEFLDM | | | | | |
| 323 | RPQRAtSNVF | 13 | 22 | L | P19105 | Myosin regulatory light chain 12A |
| 1727 | RPQRAtSNVV | | | | | |
| 1728 | RPQRAtSNVL | | | | | |
| 1729 | RPQRAtSNVM | | | | | |
| 324 | RPQRATsNVF | 13 | 22 | L | P19105 | Myosin regulatory light chain 12A |
| 1730 | RPQRATsNVV | | | | | |
| 1731 | RPQRATsNVL | | | | | |
| 1732 | RPQRATsNVM | | | | | |
| 325 | RPRANsGGVDL | 1162 | 1172 | L | Q92766 | Ras-responsive element-binding protein 1 |
| 1733 | RPRANsGGVDV | | | | | |
| 1734 | RPRANsGGVDF | | | | | |
| 1735 | RPRANsGGVDM | | | | | |
| 326 | RPRGsQSLL | 1040 | 1047 | M | P21860 | Receptor tyrosine-protein kinase erbB-3 |
| 1736 | RPRGsQSLV | | | | | |
| 1737 | RPRGsQSLF | | | | | |
| 1738 | RPRGsQSLM | | | | | |
| 327 | RPRPHsAPSL | 108 | 117 | L | Q5JXC2 | Migration and invasion-inhibitory protein |
| 1739 | RPRPHsAPSV | | | | | |
| 1740 | RPRPHsAPSF | | | | | |
| 1741 | RPRPHsAPSM | | | | | |
| 328 | RPRPVsPSSL | 430 | 439 | L | P57059 | Serine/threonine-protein kinase SIK1 |

TABLE 17-continued

Phosphopeptides Presented in Association with Class I Molecules on Cancer Cells with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1742 | RPRPVsPSSV | | | | | |
| 1743 | RPRPVsPSSF | | | | | |
| 1744 | RPRPVsPSSM | | | | | |
| 329 | RPRRsSTQL | 31 | 39 | M | A5D8T4 | TNFRSF8/Tumor necrosis factor receptor family member 8 (CD30 antigen) |
| 1745 | RPRRsSTQV | | | | | |
| 1746 | RPRRsSTQF | | | | | |
| 1747 | RPRRsSTQM | | | | | |
| 330 | RPRsAVLL | 1873 | 1880 | L | Q12802 | A-kinase anchor protein 13 |
| 1748 | RPRsAVLV | | | | | |
| 1749 | RPRsAVLF | | | | | |
| 1750 | RPRsAVLM | | | | | |
| 331 | RPRsLEVTI | 239 | 247 | L | O15553 | Pyrin |
| 1751 | RPRsLEVTL | | | | | |
| 1752 | RPRsLEVTV | | | | | |
| 1753 | RPRsLEVTF | | | | | |
| 1754 | RPRsLEVTM | | | | | |
| 332 | RPRSLsSPTVTL | 443 | 454 | M | Q96PU5 | E3 ubiquitin-protein ligase NEDD4-like |
| 1755 | RPRSLsSPTVTV | | | | | |
| 1756 | RPRSLsSPTVTF | | | | | |
| 1757 | RPRSLsSPTVTM | | | | | |
| 333 | RPRsPAARL | 111 | 119 | L | Q9P2Y4 | Zinc finger protein 219 |
| 1758 | RPRsPAARV | | | | | |
| 1759 | RPRsPAARF | | | | | |
| 1760 | RPRsPAARM | | | | | |
| 334 | RPRsPGSNSKV | 671 | 681 | L | P78347 | General transcription factor III |
| 1761 | RPRsPGSNSKV | | | | | |
| 1762 | RPRsPGSNSKV | | | | | |
| 1763 | RPRsPGSNSKV | | | | | |
| 335 | RPRsPPPRAP | 499 | 508 | M | O43900 | PRICKLE3/Prickle-like protein 3 |
| 1764 | RPRsPPPRAP | | | | | |
| 1765 | RPRsPPPRAP | | | | | |
| 1766 | RPRsPPPRAP | | | | | |
| 336 | RPRsPRENSI | 689 | 698 | L | Q99700 | Ataxin-2 |
| 1767 | RPRsPRENSL | | | | | |
| 1768 | RPRsPRENSV | | | | | |
| 1769 | RPRsPRENSF | | | | | |

TABLE 17-continued

Phosphopeptides Presented in Association with Class I Molecules on Cancer Cells with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1770 | RPRsPRENSM | | | | | |
| 337 | RPRsPSPIS | 1015 | 1023 | L | P41594 | Metabotropic glutamate receptor 5 |
| 1771 | RPRsPSPIL | | | | | |
| 1772 | RPRsPSPIV | | | | | |
| 1773 | RPRsPSPIF | | | | | |
| 1774 | RPRsPSPIM | | | | | |
| 338 | RPRsPTGP | 219 | 226 | L | Q96I25 | Splicing factor 45 |
| 1775 | RPRsPTGL | | | | | |
| 1776 | RPRsPTGV | | | | | |
| 1777 | RPRsPTGF | | | | | |
| 1778 | RPRsPTGM | | | | | |
| 339 | RPRsPTGPsNSF | 219 | 230 | L | Q96I25 | Splicing factor 45 |
| 1779 | RPRsPTGPsNSL | | | | | |
| 1780 | RPRsPTGPsNSV | | | | | |
| 1781 | RPRsPTGPsNSM | | | | | |
| 340 | RPRPVsPSSL | 430 | 439 | L | P57059 | Serine/threonine-protein kinase SIK1 |
| 1782 | RPRPVsPSSV | | | | | |
| 1783 | RPRPVsPSSF | | | | | |
| 1784 | RPRPVsPSSM | | | | | |
| 341 | RPSGRREsL | 1757 | 1765 | M | Q14643 | ITPR1/Inositol 1,4,5-triphosphate receptor, type 1 |
| 1785 | RPSGRREsV | | | | | |
| 1786 | RPSGRREsF | | | | | |
| 1787 | RPSGRREsM | | | | | |
| 342 | RPSRSsPGL | 859 | 867 | L | Q8N3V7 | Synaptopodin |
| 1788 | RPSRSsPGV | | | | | |
| 1789 | RPSRSsPGF | | | | | |
| 1790 | RPSRSsPGM | | | | | |
| 343 | RPSsLPDL | 661 | 668 | L | Q8NFD5 | AT-rich interactive domain-containing protein 1B |
| 1791 | RPSsLPDV | | | | | |
| 1792 | RPSsLPDF | | | | | |
| 1793 | RPSsLPDM | | | | | |
| 344 | RPsSPALYF | 261 | 269 | L | Q9Y3Q8 | TSC22 domain family protein 4 |
| 1794 | RPsSPALYL | | | | | |
| 1795 | RPsSPALYV | | | | | |
| 1796 | RPsSPALYM | | | | | |
| 345 | RPStPKSDSEL | 246 | 256 | L | Q14693 | Phosphatidate phosphatase LPIN1 |
| 1797 | RPStPKSDSEV | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1798 | RPStPKSDSEF | | | | | |
| 1799 | RPStPKSDSEM | | | | | |
| 346 | RPTsRLNRL | 860 | 868 | L | Q15788 | Nuclear receptor coactivator 1 |
| 1800 | RPTsRLNRV | | | | | |
| 1801 | RPTsRLNRF | | | | | |
| 1802 | RPTsRLNRM | | | | | |
| 347 | RPVsPFQEL | | | L | | No database hit |
| 1803 | RPVsPFQEV | | | | | |
| 1804 | RPVsPFQEF | | | | | |
| 1805 | RPVsPFQEM | | | | | |
| 348 | RPVsPGKDI | 406 | 414 | L | P31629 | Transcription factor HIVEP2 |
| 1806 | RPVsPGKDL | | | | | |
| 1807 | RPVsPGKDV | | | | | |
| 1808 | RPVsPGKDF | | | | | |
| 1809 | RPVsPGKDM | | | | | |
| 349 | RPVtPVSDL | 63 | 71 | L | Q13118 | Krueppel-like factor 10 |
| 1810 | RPVtPVSDV | | | | | |
| 1811 | RPVtPVSDF | | | | | |
| 1812 | RPVtPVSDM | | | | | |
| 350 | RPWsPAVSA | 380 | 388 | L | P12755 | Ski oncogene |
| 1813 | RPWsPAVSL | | | | | |
| 1814 | RPWsPAVSV | | | | | |
| 1815 | RPWsPAVSF | | | | | |
| 1816 | RPWsPAVSM | | | | | |
| 351 | RPYsPPFFSL | 187 | 196 | L | Q9NYF3 | Protein FAM53C |
| 1817 | RPYsPPFFSV | | | | | |
| 1818 | RPYsPPFFSF | | | | | |
| 1819 | RPYsPPFFSM | | | | | |
| 352 | RRKsQVAEL | 244 | 252 | L | Q9BYG3 | MKI67 FHA domain-interacting nucleolar phosphoprotein |
| 1820 | RRKsQVAEV | | | | | |
| 1821 | RRKsQVAEF | | | | | |
| 1822 | RRKsQVAEM | | | | | |
| 1823 | RPKsQVAEL | | | | | |
| 1824 | RPKsQVAEV | | | | | |
| 1825 | RPKsQVAEF | | | | | |
| 1826 | RPKsQVAEM | | | | | |

TABLE 17-continued

Phosphopeptides Presented in Association with Class I Molecules on Cancer Cells with Sequence Variations for Use in Immunotherapy: Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 353 | RRLsGPLHTL | 610 | 619 | M | Q86Y91 | Kinesin-like protein KIF18B |
| 1827 | RRLsGPLHTV | | | | | |
| 1828 | RRLsGPLHTF | | | | | |
| 1829 | RRLsGPLHTM | | | | | |
| 354 | RRPsYTLGM | 1629 | 1637 | M | O43166 | Signal induced proliferation associated 1-like protein 1 |
| 1830 | RRPsYTLGV | | | | | |
| 1831 | RRPsYTLGL | | | | | |
| 1832 | RRPsYTLGF | | | | | |
| 355 | RRssFLQVF | 585 | 593 | M | Q15436 | Protein transport protein Sec23A |
| 1833 | RRssFLQVV | | | | | |
| 1834 | RRssFLQLF | | | | | |
| 1835 | RRssFLQVM | | | | | |
| 356 | RRSsLDAEIDSL | 113 | 124 | L | Q93052 | Lipoma-preferred partner |
| 1836 | RRSsLDAEIDSV | | | | | |
| 1837 | RRSsLDAEIDSF | | | | | |
| 1838 | RRSsLDAEIDSM | | | | | |
| 1839 | RPSsLDAEIDSL | | | | | |
| 1840 | RPSsLDAEIDSV | | | | | |
| 1841 | RPSsLDAEIDSF | | | | | |
| 1842 | RPSsLDAEIDSM | | | | | |
| 357 | RRsSQSWSL | 29 | 37 | M | Q9Y4E1 | Protein FAM21C |
| 1843 | RRsSQSWSV | | | | | |
| 1844 | RRsSQSWSF | | | | | |
| 1845 | RRsSQSWSM | | | | | |
| 358 | RSEsKDRKL | 196 | 204 | L | Q92551 | Inositol hexakisphosphate kinase 1 |
| 1846 | RSEsKDRKV | | | | | |
| 1847 | RSEsKDRKF | | | | | |
| 1848 | RSEsKDRKM | | | | | |
| 1849 | RPEsKDRKL | | | | | |
| 1850 | RPEsKDRKV | | | | | |
| 1851 | RPEsKDRKF | | | | | |
| 1852 | RPEsKDRKM | | | | | |
| 359 | RSGsLERKV | 1119 | 1127 | L | O94964 | Uncharacterized protein C20orf117 |
| 1853 | RSGsLERKL | | | | | |
| 1854 | RSGsLERKF | | | | | |
| 1855 | RSGsLERKM | | | | | |
| 1856 | RPGsLERKV | | | | | |

TABLE 17-continued

Phosphopeptides Presented in Association with Class I Molecules on Cancer Cells with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1857 | RPGsLERKL | | | | | |
| 1858 | RPGsLERKF | | | | | |
| 1859 | RPGsLERKM | | | | | |
| 360 | RSLsPGGAA | 291 | 299 | L | Q96T37 | Putative RNA-binding protein 15 |
| 1860 | RSLsPGGAL | | | | | |
| 1861 | RSLsPGGAV | | | | | |
| 1862 | RSLsPGGAF | | | | | |
| 1863 | RSLsPGGAM | | | | | |
| 1864 | RPLsPGGAL | | | | | |
| 1865 | RPLsPGGAV | | | | | |
| 1866 | RPLsPGGAF | | | | | |
| 1867 | RPLsPGGAM | | | | | |
| 361 | RSLsPLLF | 3315 | 3322 | L | Q5THJ4 | Vacuolar protein sorting-associated protein 13D |
| 1868 | RSLsPLLL | | | | | |
| 1869 | RSLsPLLV | | | | | |
| 1870 | RSLsPLLM | | | | | |
| 1871 | RPLsPLLF | | | | | |
| 1872 | RPLsPLLL | | | | | |
| 1873 | RPLsPLLV | | | | | |
| 1874 | RPLsPLLM | | | | | |
| 362 | RSRsPRPAL | | | M | | no data base hit |
| 1875 | RSRsPRPAV | | | | | |
| 1876 | RSRsPRPAF | | | | | |
| 1877 | RSRsPRPAM | | | | | |
| 363 | RTEsDSGLKK | 2495 | 2504 | L | Q12802 | A-kinase anchor protein 13 |
| 1878 | RTEsDSGLKL | | | | | |
| 1879 | RTEsDSGLKV | | | | | |
| 1880 | RTEsDSGLKF | | | | | |
| 1881 | RTEsDSGLKM | | | | | |
| 1882 | RPEsDSGLKL | | | | | |
| 1883 | RPEsDSGLKV | | | | | |
| 1884 | RPEsDSGLKF | | | | | |
| 1885 | RPEsDSGLKM | | | | | |
| 364 | RTFsPTYGL | 426 | 434 | M | O15061 | SYNM/Synemin/desmuslin |
| 1886 | RTFsPTYGV | | | | | |
| 1887 | RTFsPTYGF | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1888 | RTFsPTYGM | | | | | |
| 365 | RTRsPSPTL | 515 | 523 | M | Q86UU1 | Pleckstrin homology-like domain family B |
| 1889 | RTRsPSPTV | | | | | |
| 1890 | RTRsPSPTF | | | | | |
| 1891 | RTRsPSPTM | | | | | |
| 366 | RVRsPTRSP | 158 | 166 | L | Q03164 | Histone-lysine N-methyltransferase MLL |
| 1892 | RVRsPTRSL | | | | | |
| 1893 | RVRsPTRSV | | | | | |
| 1894 | RVRsPTRSF | | | | | |
| 1895 | RVRsPTRSM | | | | | |
| 1896 | RPRsPTRSL | | | | | |
| 1897 | RPRsPTRSV | | | | | |
| 1898 | RPRsPTRSF | | | | | |
| 1899 | RPRsPTRSM | | | | | |
| 367 | SPAsPKISL | 493 | 501 | L | Q8WWM7 | Ataxin-2-like protein |
| 1900 | SPAsPKISV | | | | | |
| 1901 | SPAsPKISF | | | | | |
| 1902 | SPAsPKISM | | | | | |
| 368 | SPEKAGRRsSL | 588 | 598 | L | A6NC98 | Coiled-coil domain-containing protein 88B |
| 1903 | SPEKAGRRsSV | | | | | |
| 1904 | SPEKAGRRsSF | | | | | |
| 1905 | SPEKAGRRsSM | | | | | |
| 369 | SPFKRQLsL | 288 | 296 | M | P49757 | NUMB/Numb protein homolog |
| 1906 | SPFKRQLsV | | | | | |
| 1907 | SPFKRQLsF | | | | | |
| 1908 | SPFKRQLsM | | | | | |
| 370 | SPGLARKRsL | 851 | 860 | L | Q9H2Y7 | Zinc finger protein 106 homolog |
| 1909 | SPGLARKRsV | | | | | |
| 1910 | SPGLARKRsF | | | | | |
| 1911 | SPGLARKRsM | | | | | |
| 371 | SPKsPGLKA | 105 | 113 | L | Q6JBY9 | CapZ-interacting protein |
| 1912 | SPKsPGLKL | | | | | |
| 1913 | SPKsPGLKV | | | | | |
| 1914 | SPKsPGLKF | | | | | |
| 1915 | SPKsPGLKM | | | | | |
| 372 | SPKsPTAAL | 425 | 433 | M | Q53EZ4 | Centrosomal protein of 55 kDa |
| 1916 | SPKsPTAAV | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1917 | SPKsPTAAF | | | | | |
| 1918 | SPKsPTAAM | | | | | |
| 373 | SPRERsPAL | 243 | 251 | M | Q9Y2W1 | Thyroid hormone receptor associated protein 3 |
| 1919 | SPRERsPAL | | | | | |
| 1920 | SPRERsPAL | | | | | |
| 1921 | SPRERsPAL | | | | | |
| 374 | SPRRsRSISL | 159 | 168 | L/M | Q16629 | Serine/Arginine-rich splicing factor 7 |
| 1922 | SPRRsRSISV | | | | | |
| 1923 | SPRRsRSISF | | | | | |
| 1924 | SPRRsRSISM | | | | | |
| 375 | SPRRsRSIsL | 159 | 168 | L/M | Q16629 | Serine/Arginine-rich splicing factor 7 |
| 1925 | SPRRsRSIsV | | | | | |
| 1926 | SPRRsRSIsF | | | | | |
| 1927 | SPRRsRSIsM | | | | | |
| 1928 | SPRsITSTV | | | | | |
| 1929 | SPRsITSTL | | | | | |
| 1930 | SPRsITSTF | | | | | |
| 1931 | SPRsITSTM | | | | | |
| 377 | SPRsPGKPM | | | L | | No database hit |
| 1932 | SPRsPGKPL | | | | | |
| 1933 | SPRsPGKPV | | | | | |
| 1934 | SPRsPGKPF | | | | | |
| 378 | SPRsPGRSL | | | | | No data base hit |
| 1935 | SPRsPGRSV | | | | | |
| 1936 | SPRsPGRSF | | | | | |
| 1937 | SPRsPGRSM | | | | | |
| 379 | SPRsPSTTYL | 772 | 781 | L | Q13111 | Chromatin assemply factor 1 subunit A |
| 1938 | SPRsPSTTYV | | | | | |
| 1939 | SPRsPSTTYF | | | | | |
| 1940 | SPRsPSTTYM | | | | | |
| 380 | SPRTPVsPVKF | 441 | 451 | M | P23443 | Ribosomal protein S6 kinase beta-1 |
| 1941 | SPRTPVsPVKL | | | | | |
| 1942 | SPRTPVsPVKV | | | | | |
| 1943 | SPRTPVsPVKM | | | | | |
| 381 | SPRtPVsPVKF | 441 | 451 | M | P23443 | Ribosomal protein S6 kinase beta-1 |
| 1944 | SPRtPVsPVKL | | | | | |

TABLE 17-continued

Phosphopeptides Presented in Association with Class I Molecules on Cancer Cells
with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1945 | SPRtPVsPVKV | | | | | |
| 1946 | SPRtPVsPVKM | | | | | |
| 382 | SPSsPSVRRQL | 1988 | 1998 | L | O75179 | Ankyrin repeat domain-containing protein 17 |
| 1947 | SPSsPSVRRQV | | | | | |
| 1948 | SPSsPSVRRQF | | | | | |
| 1949 | SPSsPSVRRQM | | | | | |
| 383 | SPSTSRSGGsSRL | 18 | 30 | L | Q9BUV0 | UPF0471 protein C1orf63 |
| 1950 | SPSTSRSGGsSRV | | | | | |
| 1951 | SPSTSRSGGsSRF | | | | | |
| 1952 | SPSTSRSGGsSRM | | | | | |
| 384 | SPVVHQsL | 614 | 621 | M | Q15678 | Tyrosine-protein phosphatase non-receptor type 14 |
| 1953 | SPVVHQsV | | | | | |
| 1954 | SPVVHQsF | | | | | |
| 1955 | SPVVHQsM | | | | | |
| 385 | TPAQPQRRsL | 113 | 122 | L | Q9ULW0 | Targeting protein for Xklp2 |
| 1956 | TPAQPQRRsV | | | | | |
| 1957 | TPAQPQRRsF | | | | | |
| 1958 | TPAQPQRRsM | | | | | |
| 386 | TPIsPGRASGM | 273 | 283 | L | Q01196 | Runt-related transcription factor 1 |
| 1959 | TPIsPGRASGF | | | | | |
| 1960 | TPIsPGRASGV | | | | | |
| 1961 | TPIsPGRASGL | | | | | |
| 387 | TPRsPPLGL | 755 | 763 | L | Q16584 | Mitogen-activated protein kinase kinase kinase 11 |
| 1962 | TPRsPPLGV | | | | | |
| 1963 | TPRsPPLGF | | | | | |
| 1964 | TPRsPPLGM | | | | | |
| 388 | TPRsPPLGLI | 755 | 764 | L | Q16584 | Mitogen-activated protein kinase kinase kinase 11 |
| 1965 | TPRsPPLGLL | | | | | |
| 1966 | TPRsPPLGLV | | | | | |
| 1967 | TPRsPPLGLF | | | | | |
| 1968 | TPRsPPLGLM | | | | | |
| 389 | VPRsPKHAHSSSL | 242 | 254 | L | O95425 | Supervillin |
| 1969 | VPRsPKHAHSSSV | | | | | |
| 1970 | VPRsPKHAHSSSF | | | | | |
| 1971 | VPRsPKHAHSSSM | | | | | |
| 390 | YPSsPRKL | | | M | | No data base hit |
| 1972 | YPSsPRKV | | | | | |

TABLE 17-continued

Phosphopeptides Presented in Association with Class I Molecules on Cancer Cells with Sequence Variations for Use in Immunotherapy:
Melanoma (M) and/or Leukemia (L) HLA-B*0702 Phosphopeptides

| SEQ ID NO. | Sequence | Start | Stop | L/M | UniProt | Source Protein |
|---|---|---|---|---|---|---|
| 1973 | YPSsPRKF | | | | | |
| 1974 | YPSsPRKM | | | | | |
| 391 | YQRsFDEVEGV | 136 | 146 | L | Q6Y7W6 | PERQ amino acid-rich with GYF domain-containing protein 2 |
| 1975 | YQRsFDEVEGL | | | | | |
| 1976 | YQRsFDEVEGF | | | | | |
| 1977 | YQRsFDEVEGM | | | | | |
| 1978 | YPRsFDEVEGV | | | | | |
| 1979 | YPRsFDEVEGL | | | | | |
| 1980 | YPRsFDEVEGF | | | | | |
| 1981 | YPRsFDEVEGM | | | | | |
| 392 | YQRsFDEVEGVF | 136 | 147 | L | Q6Y7W6 | PERQ amino acid-rich with GYF domain-containing protein 2 |
| 1982 | YQRsFDEVEGVL | | | | | |
| 1983 | YQRsFDEVEGVV | | | | | |
| 1984 | YQRsFDEVEGVM | | | | | |
| 1985 | YPRsFDEVEGVF | | | | | |
| 1986 | YPRsFDEVEGVL | | | | | |
| 1987 | YPRsFDEVEGVV | | | | | |
| 1988 | YPRsFDEVEGVM | | | | | |

Column 2: Phosphopeptide sequences; pSer, pThr and pTyr are specified by s, t, and y, respectively.
For immunotherapy, s, t, and y can be replaced by the phospho-residue mimetics, F2Pab, F2Pmb, and F2Pmp, respectively.
Column 3 & 4: Entries define the location of the phosphopeptides within the sequence of the parent protein.
Column 5: Protein identifier in the UniProt database, www[dot]uniprot[dot]org
Column 6: Name of the protein in the UniProt database.

TABLE 18

Phosphopeptides Presented in Association with Class I MHC Molecules on Cancer Cells with Sequence Variations and Modifications for Use in Immunotherapy

| SEQ ID No. | Sequence | Start | Stop | UniProt | Source Protein |
|---|---|---|---|---|---|
| | | | Melanoma HLA A*0201 Phosphopeptide | | |
| 393 | ALYsPAQPSL | 301 | 310 | Q9NXE4 | SMPD4/Sphingomyelin phopshodiesterase 4 |
| 1989 | ALYsPAQPSV | | | | |
| 394 | AMAAsPHAV | 64 | 72 | Q13151 | Heterogeneous nuclear ribonucleoprotein A0 (HNRNPA0) |
| 1990 | ALAAsPHAV | | | | |
| 395 | AVVsPPALHNA | 855 | 865 | O60885 | bromodomain-containing protein-4 (BRD4) |
| 1991 | AVVsPPALHNV | | | | |
| 1992 | ALVsPPALHNV | | | | |
| 1993 | ALVsPPALHNA | | | | |

TABLE 18-continued

Phosphopeptides Presented in Association with Class I MHC Molecules on Cancer Cells with Sequence Variations and Modifications for Use in Immunotherapy

| SEQ ID No. | Sequence | Start | Stop | UniProt | Source Protein |
|---|---|---|---|---|---|
| 1994 | AMVsPPALHNA | | | | |
| 1995 | AMVsPPALHNV | | | | |
| 396 | GLLGsPVRV | 38 | 46 | P30305 | M-phase inducer phosphatase 2 (CDC25B) |
| 1996 | GMLGsPVRV | | | | |
| 397 | ILKsPEIQRA | 292 | 301 | P36578 | 60S ribosomal protein L4 (RPL4) |
| 1997 | ILKsPEIQRV | | | | |
| 1998 | IMKsPEIQRV | | | | |
| 1999 | IMKsPEIQRA | | | | |
| 398 | IMDRtPEKL | 126 | 134 | O75815 | Breast cancer anti-estrogen resistance 3 (BCAR3) |
| 2000 | ILDRtPEKL | | | | |
| 2001 | IMDRtPEKV | | | | |
| 2002 | ILDRtPEKV | | | | |
| 399 | KLAsPELERL | 97 | 106 | P17535 | Transcription factor jun-D (JUND) {70-79/P05412/ Transcription factor AP-1/JUN} |
| 2003 | KMAsPELERL | | | | |
| 2004 | KLAsPELERV | | | | |
| 2005 | KMAsPELERV | | | | |
| 400 | KLFPDtPLAL | 587 | 596 | Q12906 | Interleukin enhancer-binding factor 3 (ILF3) |
| 2006 | KMFPDtPLAL | | | | |
| 2007 | KLFPDtPLAV | | | | |
| 2008 | KMFPDtPLAV | | | | |
| 401 | KLIDIVsSQKV | 461 | 471 | O14757 | Serine/threonine-protein kinase Chk1 (CHEK1) |
| 2009 | KMIDIVsSQKV | | | | |
| 402 | KLLDFGSLsNLQV | 107 | 119 | P08708 | 40S ribosomal protein S17 (RPS17) |
| 2010 | KMLDFGSLsNLQV | | | | |
| 403 | KLLsPSNEKL | 544 | 553 | Q14694 | Ubiquitin carboxyl-terminal hydrolase 10 (USP10) |
| 2011 | KMLsPSNEKL | | | | |
| 2012 | KLLsPSNEKV | | | | |
| 2013 | KMLsPSNEKV | | | | |
| 404 | KLLSSAQRtL | 29 | 38 | Q14929 | Zinc finger protein 169 (ZNF169) |
| 2014 | KMLSSAQRtL | | | | |
| 2015 | KLLSSAQRtV | | | | |
| 2016 | KMLSSAQRtV | | | | |
| 405 | KLMsPKADVKL | 44 | 54 | Q86T90 | Uncharacterized protein KIAA1328 (KIAA1328) |
| 2017 | KMMsPKADVKL | | | | |
| 2018 | KLMsPKADVKV | | | | |
| 2019 | KMMsPKADVKV | | | | |

TABLE 18-continued

Phosphopeptides Presented in Association with Class I MHC Molecules on Cancer Cells with Sequence Variations and Modifications for Use in Immunotherapy

| SEQ ID No. | Sequence | Start | Stop | UniProt | Source Protein |
|---|---|---|---|---|---|
| 406 | KVQVtSLSV | 3 | 10 | Q8TE06 | SLTP004 (predicted) |
| 2020 | KLQVtSLSV | | | | |
| 407 | LMFsPVTSL | 887 | 895 | Q9C0A6 | SET domain-containing protein 5 (SETD5) |
| 2021 | LLFsPVTSL | | | | |
| 2022 | LMFsPVTSV | | | | |
| 2023 | LLFsPVTSV | | | | |
| 408 | RLDsYVRSL | 129 | 137 | Q9Y5R8 | Trafficking protein particle complex subunit 1 (TRAPPC1) |
| 2024 | RMDsYVRSL | | | | |
| 2025 | RLDsYVRSV | | | | |
| 2026 | RMDsYVRSV | | | | |
| 409 | RLFsKELRC | 30 | 38 | Q15543 | Transcription iniation factor TFIID subunit 13 (TAF13) |
| 2027 | RMFsKELRC | | | | |
| 2028 | RLFsKELRV | | | | |
| 2029 | RMFsKELRV | | | | |
| 410 | RLLsPLSSA | 581 | 589 | Q8IY67-2 | Ribonucleoprotein PTB-binding 1 (RAVER1) |
| 2030 | RMLsPLSSA | | | | |
| 2031 | RLLsPLSSV | | | | |
| 2032 | RMLsPLSSV | | | | |
| 411 | RLQsTSERL | 217 | 225 | Q96TA2 | ATP-dependent zinc metalloprotease YME1L1 (YME1L1) |
| 2033 | RMQsTSERL | | | | |
| 2034 | RLQsTSERV | | | | |
| 2035 | RMQsTSERV | | | | |
| 412 | RLSsPLHFV | 400 | 408 | Q8NC44 | Protein FAM134A (FAM134A) |
| 2036 | RMSsPLHFV | | | | |
| 413 | RQDsTPGKVFL | 61 | 71 | P13056 | Nuclear receptor subfamily 2 group C member 1 (NR2C1) |
| 2037 | RLDsTPGKVFL | | | | |
| 2038 | RMDsTPGKVFL | | | | |
| 2039 | RQDsTPGKVFV | | | | |
| 2040 | RMDsTPGKVFV | | | | |
| 2041 | RLDsTPGKVFV | | | | |
| 414 | RQIsQDVKL | 165 | 173 | Q01433 | AMP deaminase 2 (AMPD2) |
| 2042 | RLIsQDVKL | | | | |
| 2043 | RMIsQDVKL | | | | |
| 2044 | RQIsQDVKV | | | | |
| 2045 | RLIsQDVKV | | | | |
| 2046 | RMIsQDVKV | | | | |
| 415 | RQLsSGVSEI | 79 | 88 | P04792 | Heat shock protein beta 1 (HSPB1) |

TABLE 18-continued

Phosphopeptides Presented in Association with Class I MHC Molecules on Cancer Cells with Sequence Variations and Modifications for Use in Immunotherapy

| SEQ ID No. | Sequence | Start | Stop | UniProt | Source Protein |
|---|---|---|---|---|---|
| 2047 | RLLsSGVSEI | | | | |
| 2048 | RMLsSGVSEI | | | | |
| 2049 | RQLsSGVSEV | | | | |
| 2050 | RLLsSGVSEV | | | | |
| 2051 | RMLsSGVSEV | | | | |
| 416 | RTFsPTYGL | 426 | 434 | O15061 | Synemin (SYNM) |
| 2052 | RLFsPTYGL | | | | |
| 2053 | RMFsPTYGL | | | | |
| 2054 | RTFsPTYGV | | | | |
| 2055 | RLFsPTYGV | | | | |
| 2056 | RMFsPTYGV | | | | |
| 417 | RTLsHISEA | 450 | 458 | Q6ZS17 | Protein FAM65A (FAM65A) |
| 2057 | RLLsHISEA | | | | |
| 2058 | RMLsHISEA | | | | |
| 2059 | RTLsHISEV | | | | |
| 2060 | RLLsHISEV | | | | |
| 2061 | RMLsHISEV | | | | |
| 418 | RVAsPTSGV | 1097 | 1105 | Q9Y4H2 | Insulin receptor substrate 2 (IRS2) |
| 2062 | RLAsPTSGV | | | | |
| 2063 | RMAsPTSGV | | | | |
| 419 | SLLTsPPKA | 938 | 946 | Q14669 | Probable E3 ubiquitin-protein ligase TRIP12 (TRIP12) |
| 2064 | SMLTsPPKA | | | | |
| 2065 | SLLTsPPKV | | | | |
| 2066 | SMLTsPPKV | | | | |
| 420 | SLQPRSHsV | 448 | 456 | Q9Y2H5 | Pleckstrin homology domain-containing family A member 6 (PLEKHA6) |
| 2067 | SMQPRSHsV | | | | |
| 421 | SMtRSPPRV | 248 | 256 | Q9BRL6 | Serine/arginine-rich splicing factor 8 (SRSF8) |
| 2068 | SLtRSPPRV | | | | |
| 422 | TLAsPSVFKST | 38 | 48 | Q6PGQ7 | Protein aurora borealis (BORA) |
| 2069 | TMAsPSVFKST | | | | |
| 2070 | TLAsPSVFKSV | | | | |
| 2071 | TMAsPSVFKSV | | | | |
| 423 | VLKGsRSSEL | 38 | 47 | Q96B45 | UPF0693/C10orf32 |
| 2072 | VLKGsRSSEV | | | | |
| 424 | VLLsPVPEL | 552 | 560 | Q9H1A4 | Anaphase-promoting complex subunit 1 (ANAPC1) |
| 2073 | VMLsPVPEL | | | | |

TABLE 18-continued

Phosphopeptides Presented in Association with Class I MHC Molecules on Cancer Cells
with Sequence Variations and Modifications for Use in Immunotherapy

| SEQ ID No. | Sequence | Start | Stop | UniProt | Source Protein |
|---|---|---|---|---|---|
| 2074 | VLLsPVPEV | | | | |
| 2075 | VMLsPVPEV | | | | |
| 425 | VMFRtPLASV | 319 | 328 | Q9UKT4 | F-box only protein 5 (FBXO5) |
| 2076 | VLFRtPLASV | | | | |
| 426 | VMIGsPKKV | 1437 | 1445 | Q68CZ2 | Tensin-3 (TNS3) |
| 2077 | VLIGsPKKV | | | | |
| 427 | YLDsGIHSGA | 30 | 39 | P35222 | Catenin beta-1 (CTNNB1) |
| 2078 | YMDsGIHSGA | | | | |
| 2079 | YMDsGIHSGV | | | | |
| 2080 | YLDsGIHSGV | | | | |
| 2081 | YLDsGIHsGA | | | | |
| 2082 | YMDsGIHsGA | | | | |
| 2083 | YMDsGIHsGV | | | | |
| 2084 | YLDsGIHsGV | | | | |

HLA-A*0201 Phosphopepyides on Leukemia or Transformed B-cells

| SEQ ID No. | Sequence | Start | Stop | UniProt | Source Protein |
|---|---|---|---|---|---|
| 428 | ALDsGASLLHL | 482 | 492 | P57078 | Receptor-interacting serine/threonine-protein kinase 4 |
| 2085 | AMDsGASLLHL | | | | |
| 2086 | ALDsGASLLHV | | | | |
| 2087 | AMDsGASLLHV | | | | |
| 429 | ALGsRESLATI | 225 | 235 | Q86YV0 | RAS Protein activator like-3 |
| 2088 | ALGsRESLATV | | | | |
| 2089 | AMGsRESLATI | | | | |
| 2090 | AMGsRESLATV | | | | |
| 430 | AMLGSKsPDPYRL | 904 | 916 | P18583 | Protein SON |
| 2091 | AMLGSKsPDPYRV | | | | |
| 2092 | ALLGSKsPDPYRL | | | | |
| 2093 | ALLGSKsPDPYRV | | | | |
| 431 | AVIHQsLGL | 251 | 259 | Q9BV87 | Protein CNPPD1 |
| 2094 | AVIHQsLGV | | | | |
| 2095 | ALIHQsLGL | | | | |
| 2096 | ALIHQsLGV | | | | |
| 432 | DSsEEKFL | 20 | 27 | P02808 | Statherin (saliva) |
| 2097 | DLsEEKFL | | | | |
| 2098 | DSsEEKFV | | | | |
| 2099 | DLsEEKFV | | | | |
| 433 | GGSFGGRSSGsP | 348 | 359 | P51991 | Heterogeneous nuclear ribonucleoprotein A3, HNRNPA3 |
| 2100 | GGSFGGRSSGsV | | | | |

TABLE 18-continued

Phosphopeptides Presented in Association with Class I MHC Molecules on Cancer Cells with Sequence Variations and Modifications for Use in Immunotherapy

| SEQ ID No. | Sequence | Start | Stop | UniProt | Source Protein |
|---|---|---|---|---|---|
| 2101 | GLSFGGRSSGsP | | | | |
| 2102 | GLSFGGRSSGsV | | | | |
| 434 | GLLsPARLYAI | 355 | 365 | P42704 | Leucine rich PPR-motif containing protein mito. precursor |
| 2103 | GLLsPARLYAV | | | | |
| 2104 | GMLsPARLYAI | | | | |
| 2105 | GMLsPARLYAV | | | | |
| 435 | ILDsGIYRI | 51 | 59 | Q9UPZ3 | Hermansky-Pudlak syndrome 5 protein |
| 2106 | ILDsGIYRV | | | | |
| 2107 | IMDsGIYRI | | | | |
| 2108 | IMDsGIYRV | | | | |
| 436 | KAKsPAPGL | 2421 | 2429 | Q9Y618 | Nuclear receptor corepressor 2 |
| 2109 | KLKsPAPGL | | | | |
| 2110 | KAKsPAPGV | | | | |
| 2111 | KLKsPAPGV | | | | |
| 437 | KIFsGVFVKV | 114 | 123 | Q6DKI1 | 60S ribosomal protein L7-like 1 |
| 2112 | KLFsGVFVKV | | | | |
| 2113 | KMFsGVFVKV | | | | |
| 438 | KLDsPRVTV | 215 | 220 | Q96G04 | Protein FAM86A |
| 2114 | KMDsPRVTV | | | | |
| 439 | KLFsPSKEAEL | 844 | 854 | Q96RY5 | Protein cramped-like |
| 2115 | KLFsPSKEAEV | | | | |
| 2116 | KMFsPSKEAEL | | | | |
| 2117 | KMFsPSKEAEV | | | | |
| 440 | KLIDRTEsL | 197 | 205 | P33241 | Lymphocyte-specific protein 1 |
| 2118 | KMIDRTEsL | | | | |
| 2119 | KLMIDRTEsV | | | | |
| 441 | KLLQFYPsL | 77 | 85 | Q9GZY6 | Linker for activation of T-cells family member 2 |
| 2120 | KLLQFYPsV | | | | |
| 2121 | KMLQFYPsL | | | | |
| 442 | KLMAPDIsL | 52 | 60 | Q12982 | BCL2/adenovirus E1B 19 kDa protein-interacting protein 2 |
| 2122 | KLMAPDIsV | | | | |
| 2123 | KMMAPDIsV | | | | |
| 443 | KLMsPKADVKL | 44 | 54 | Q86T90 | Uncharacterized protein KIAA1328 |
| 2124 | KLMsPKADVKV | | | | |
| 2125 | KMMsPKADVKV | | | | |
| 444 | KMDsFLDMQL | 129 | 138 | Q86UW6 | NEDD4-binding protein 2 |
| 2126 | KMDsFLDMQV | | | | |

TABLE 18-continued

Phosphopeptides Presented in Association with Class I MHC Molecules on Cancer Cells with Sequence Variations and Modifications for Use in Immunotherapy

| SEQ ID No. | Sequence | Start | Stop | UniProt | Source Protein |
|---|---|---|---|---|---|
| 2127 | KLDsFLDMQV | | | | |
| 445 | KMYsEIDIKV | 646 | 655 | Q15029 | 116 Kda U5 small nuclear ribonucleoprotein component |
| 2128 | KLYsEIDIKV | | | | |
| 446 | KVAsLLHQV | 330 | 338 | Q8NFZ5 | TNFAIP3-interacting protein 2 |
| 2129 | KLAsLLHQV | | | | |
| 2130 | KMAsLLHQV | | | | |
| 447 | KVLsTEEMEL | 31 | 40 | Q6NZ67 | Protein FAM128B |
| 2131 | KLLsTEEMEL | | | | |
| 2132 | KLLsTEEMEV | | | | |
| 448 | MLAEsPSVPRL | 27 | 37 | Q8WUC7 | Putative uncharacterized protein |
| 2133 | MLAEsPSVPRV | | | | |
| 449 | RLAsLNAEAL | 118 | 127 | Q8TBE0 | Bromo adjacent homology domain-containing 1 protein |
| 2134 | RLAsLNAEAV | | | | |
| 450 | RPR(sLss)PTVTL# | 443 | 454 | Q96PU5 | E3 ubiquitin-protein ligase NEDD4-like |
| 2135 | RLR(sLss)PTVTL# | | | | |
| 2136 | RLR(sLss)PTVTV# | | | | |
| 2137 | RPR(sLss)PTVTV# | | | | |
| 451 | RQAsIELPSM | 249 | 258 | P33241 | Lymphocyte-specific protein 1 |
| 2138 | RQAsIELPSV | | | | |
| 2139 | RLAsIELPSV | | | | |
| 2140 | RLAsIELPSM | | | | |
| 452 | RQAsIELPSMAV | 249 | 260 | P33242 | Lymphocyte-specific protein 1 |
| 2141 | RLAsIELPSMAV | | | | |
| 453 | RQAsLSISV | 11 | 19 | A0JLT6 | Protein kinase 2D |
| 2142 | RLAsLSISV | | | | |
| 454 | RQIsFKAEV | 181 | 189 | Q9Y385 | Ubiquitin-conjugating enzyme E2 J1 |
| 2143 | RLIsFKAEV | | | | |
| 455 | RQIsQDVKL | 165 | 174 | Q01433 | AMP deaminase 2 |
| 2144 | RLIsQDVKL | | | | |
| 2145 | RQIsQDVKV | | | | |
| 2146 | RLIsQDVKV | | | | |
| 456 | RQLsSGVSEI | 80 | 89 | P04792 | HSPB1, heat shock protein beta 1 |
| 2147 | RLLsSGVSEI | | | | |
| 2148 | RQLsSGVSEV | | | | |
| 2149 | RLLsSGVSEV | | | | |
| 457 | RTFsPTYGL | 426 | 434 | O15061 | SYNM, Desmuslin |
| 2150 | RLFsPTYGL | | | | |

TABLE 18-continued

Phosphopeptides Presented in Association with Class I MHC Molecules on Cancer Cells with Sequence Variations and Modifications for Use in Immunotherapy

| SEQ ID No. | Sequence | Start | Stop | UniProt | Source Protein |
|---|---|---|---|---|---|
| 2151 | RTFsPTYGV | | | | |
| 2152 | RLTFsPTYGV | | | | |
| 458 | RTYsGPMNKV | 53 | 64 | Q8WVV4 | POF1B, Premature ovarian failure protein, 1B |
| 2153 | RLYsGPMNKV | | | | |
| 459 | RVAsPTSGV | 1097 | 1105 | Q9Y4H2 | Insulin Receptor Substrate 2 (IRS-2) |
| 2154 | RLAsPTSGV | | | | |
| 2155 | RMAsPTSGV | | | | |
| 460 | SMTRsPPRV | 248 | 256 | Q9BRL6 | SFRS8, Serine/arginine-rich splicing factor 8 |
| 2156 | SLTRsPPRV | | | | |
| 461 | SMtRSPPRV | 248 | 256 | Q9BRL6 | SFRS8, Serine/arginine-rich splicing factor 8 |
| 2157 | SLtRSPPRV | | | | |
| 462 | VLLsPVPEL | 551 | 559 | Q9H1A4 | Anahase promoting complex subunit 1 |
| 2158 | VLLsPVPEV | | | | |
| 463 | VLMK(sPs)PAL## | 1117 | 1126 | Q9H6S0 | YTHDC2, Probable ATP-dependent RNA helicase |
| 2159 | VLMK(sPs)PAV## | | | | |
| 464 | VMIGsPKKV | 1437 | 1445 | Q68CZ2 | Tensin-3 (TNS3) |
| 2160 | VLIGsPKKV | | | | |
| 465 | YQLsPTKLPSI | 429 | 439 | O60934 | Nibrin/cell cycle regulatory protein p95 |
| 2161 | YLLsPTKLPSI | | | | |
| 2162 | YQLsPTKLPSV | | | | |
| 2163 | YLLsPTKLPSV | 429 | 439 | O60934 | Nibrin/cell cycle regulatory protein p95 |

(sLss) indicates that one of these particular serines is phosphorylated.
(sPs) indicates that one of these particular serines is phosphorylated.
Column 2: Phosphopeptide sequences; pSer, pThr and pTyr are specified by s, t, and y, respectively. For immunotherapy, s, t, and y can be replaced by the phospho-residue mimetics, F2Pab, F2Pmb, and F2Pmp, respectively.
Column 3 & 4: Entries define the location of the phosphopeptides within the sequence of the parent protein.
Column 5: Protein identifier in the UniProt database, www[dot]uniprot[dot]org
Column 6: Name of the protein in the UniProt database.

TABLE 19

HLA-B*0702 O-GlcNAcylated Peptides on Leukemia and/or Transformed B Cells

| SEQ ID No. | Sequence | Start | Stop | UniProt | Source Protein |
|---|---|---|---|---|---|
| 2164 | IPVgSSHNSL | 147 | 155 | Q06413 | Myocyte-specific enhancer factor 2C |
| 2165 | RPPIgTQSSL | 382 | 390 | Q9P2N5 | RNA binding protein 27 |
| 2166 | Me-RPPIgTQSSL | 382 | 390 | Q9P2N5 | RNA binding protein 27 |
| 2167 | DiMe-RPPIgTQSSL | 383 | 390 | Q9P2N5 | RNA binding protein 27 |
| 2374 | VLTgSNVQTI | 507 | 515 | P32519 | ETS-related transcription factor Elf-1 |

ALL, AML, CLL, JY Only
Column 2: O-GlcNAcylated peptide sequences; O-GlcNAcylated Ser and Thr are specified by gS and gT, respectively. Mono- and Di-methylated Arg are specified by Me-R and DiMe-R, respectively.
Columns 3 & 4: Entries define the location of the O-GlcNAcylated peptides within the sequence of the parent protein.
Column 5: Protein identifier in the UniProt database, www[dot]uniprot[dot]org
Column 6: Name of the protein in the UniProt database.

TABLE 20

Characteristics of HLA-DR-associated Phosphopeptides Selectively Expressed by Melanoma Cells

| Source Protein | Phosphopeptide | SEQ ID NO |
|---|---|---|
| 1363-mel and 2048-mel Melanoma antigen recognized by T cells-1/MART-1 | $_{100}$APPAYEKLsAEQ$_{111}$ | 2227 |
| | $_{100}$APPAYEKLsAEQSPP$_{114}$ | 2228 |
| | $_{100}$APPAYEKLsAEQSPPP$_{115}$ | 2229 |
| | $_{100}$APPAYEKLsAEQSPPPY$_{116}$ | 2230 |
| Tensin-3 | $_{1434}$VSKVMIGsPKKV$_{1445}$ | 2231 |
| | $_{1437}$VMIGsPKKV$_{1445}$ | 2232 |
| 1363-mel alone Matrix-remodeling-Associated protein 7 | $_{142}$KYsPGKLRGN$_{151}$ | 2233 |
| 2048-mel alone Amino-terminal enhancer of split | $_{176}$SKEDKNGHDGDTHQEDDGEKsD$_{197}$ | 2234 |
| Ankyrin repeat domain-containing protein-54 | $_{43}$GSALGGGGAGLSGRASGGAQsPLRYLHV$_{71}$ | 2235 |
| | $_{46}$LGGGGAGLSGRASGGAQsPLRYLHV$_{71}$ | 2236 |
| | $_{58}$SGGAQsPLRYLHVL$_{72}$ | 2237 |
| Anoctamin-8 | $_{638}$EEGsPTMVEKGLEPGVFTL$_{656}$ | 2238 |
| | $_{639}$EGsPTMVEKGLEPGVFTL$_{656}$ | 2239 |
| | $_{640}$GsPTMVEKGLEPGVFTL$_{656}$ | 2240 |
| AP-3 complex subunit-Δ-1 | $_{779}$EEMPENALPsDEDDKDPNDPYRAL$_{802}$ | 2241 |
| Casein kinase II subunit-β | $_{202}$QAASNFKsPVKTIR$_{215}$ | 2242 |
| | $_{203}$AASNFKsPVKTIR$_{215}$ | 2243 |
| | $_{205}$SNFKsPVKTIR$_{215}$ | 2244 |
| | $_{206}$NFKsPVKTIR$_{215}$ | 2245 |
| | $_{207}$FKsPVKTIR$_{215}$ | 2246 |
| Claudin-11 | $_{191}$YYTAGSSsPTHAKSAHV$_{207}$ | 2247 |
| | $_{196}$SSsPTHAKSAHV$_{207}$ | 2248 |
| Emerin | $_{117}$VRQsVTSFPDADAFHHQ$_{133}$ | 2249 |
| FLJ20689 | $_{471}$FKMPQEKsPGYS$_{482}$ | 2250 |
| Insulin receptor Substrate 2 | $_{1097}$RVAsPTSGVKR$_{1107}$ | 2251 |
| Interleukin 1 receptor accessory protein | $_{543}$QVAMPVKKSPRRSsSDEQGLSYSSLKNV$_{570}$ | 2252 |
| | $_{544}$VAMPVKKSPRRSsSDEQGLSYSSLKNV$_{570}$ | 2253 |
| LUC7-like isoform b | $_{353}$SSNGKMASRRsEEKEAG$_{369}$ | 2254 |
| | $_{353}$SSNGKMASRRsEEKEAGEI$_{371}$ | 2255 |
| Membrane-associated progesterone receptor component 1 | $_{172}$KEGEEPTVYsDEEEPKDESARKND$_{195}$ | 2256 |
| | $_{173}$EGEEPTVYsDEEEPKDESARKND$_{195}$ | 2257 |
| NF-κB inhibitor-interacting Ras-like protein 2 | $_{165}$ASKMTQPQSKSAFPLSRKNKGsGsLDG$_{191}$ | 2258 |
| Probable fibrosin-1 long transcript protein isoform 2 | $_{348}$APPPLVPAPRPSsPPRGPGPARADR$_{372}$ | 2259 |
| Small acidic protein | $_{2}$SAARESHPHGVKRSAsPDDDLG$_{23}$ | 2260 |
| | $_{2}$(AcS)AARESHPHGVKRSAsPDDDLG$_{23}$* | 2261 |
| Synaptojanin-170 | $_{1561}$ASKAsPTLDFTER$_{1573}$ | 2262 |
| Tetraspanin-10 | $_{4}$GERsPLLSQETAGQKP$_{19}$ | 2263 |
| | $_{4}$GERsPLLSQETAGQKPL$_{20}$ | 2264 |
| | $_{5}$ERsPLLSQETAGQKP$_{19}$ | 2265 |
| | $_{5}$ERsPLLSQETAGQKPL$_{20}$ | 2266 |
| Transmembrane protein 184 | $_{424}$TIGEKKEPsDKSVDS$_{438}$ | 2267 |

*(AcS) indicates that the serine at amino acid 1 is acylated at the N-terminus

TABLE 21

Characteristics of HLA-DR-associated Phosphopeptides Selectively Expressed by EBV-transformed B Cells

| Source Protein | Phosphopeptide | SEQ ID NO. |
|---|---|---|
| B lymphocyte antigen CD20 | $_{25}$SGPKPLFRRMsSLVGPTQ$_{42}$ | 2268 |
| | $_{26}$GPKPLFRRMsS$_{36}$ | 2269 |
| | $_{26}$GPKPLFRRMsSL$_{37}$ | 2270 |
| | $_{26}$GPKPLFRRMsSLV$_{38}$ | 2271 |
| | $_{26}$GPKPLFRRMsSLVG$_{39}$ | 2272 |
| | $_{26}$GPKPLFRRMsSLVGP$_{40}$ | 2273 |
| | $_{26}$GPKPLFRRMsSLVGPT$_{41}$ | 2274 |
| | $_{26}$GPKPLFRRMsSLVGPTQ$_{42}$ | 2275 |
| | $_{26}$GPKPLFRRMsSLVGPTQS$_{43}$ | 2276 |
| Lymphoid-restricted membrane protein | $_{130}$AsPTIEAQGTSPAHDN$_{145}$ | 2277 |
| | $_{130}$AsPTIEAQGTSPAHDNI$_{146}$ | 2278 |
| | $_{130}$AsPTIEAQGTSPAHDNIA$_{147}$ | 2279 |
| | $_{402}$SSsWRILGSKQSEHRP$_{417}$ | 2280 |

1363-EBV alone

| Source Protein | Phosphopeptide | SEQ ID NO. |
|---|---|---|
| ADAM 8 | $_{758}$sPPFPVPVYTRQAPKQVIK$_{776}$ | 2281 |
| B lymphocyte antigen CD19 | $_{328}$DPTRRFFKVtPPPGSGPQ$_{345}$ | 2282 |
| Germinal center B cell-Expressed transcript 2 protein | $_{142/76}$RsPEDEYELLMPHRISSH$_{159/93}$ | 2283 |
| | $_{143/77}$sPEDEYELLMPHRISSH$_{159/93}$ | 2284 |
| | $_{143/77}$SPEDEYELLMPHRIsSH$_{159/93}$ | 2285 |
| | $_{149/83}$ELLMPHRIsSHF$_{160/94}$ | 2286 |
| | $_{149/83}$ELLMPHRIsSHFL$_{161/95}$ | 2287 |
| Interleukin-2 receptor subunit-5 | $_{282}$TPDPSKFFSQLsSEHGGDV$_{300}$ | 2288 |
| | $_{282}$TPDPSKFFSQLsSEHGGDVQ$_{301}$ | 2289 |
| Optineurin | $_{473}$sDFHAERAAREK$_{484}$ | 2290 |
| Phosphoglycerate kinase 1 | $_{203}$sPERPFLAILGGAKVADK$_{220}$ | 2291 |
| | $_{203}$sPERPFLAILGGAKVADKIQ$_{222}$ | 2292 |
| Solute carrier family 12, member 6, isoform a | $_{1050}$TKDKYMASRGQKAKsMEG$_{1067}$ | 2293 |
| TNFAIP3-interacting protein 1 | $_{559}$VPHHGFEDWsQIR$_{571}$ | 2294 |
| Tumor necrosis factor receptor superfamily member 8 | $_{513/50}$KIEKIyIMKADTVIVG$_{528/65}$ | 2295 |
| | $_{514/51}$IEKIyIMKADTVIVG$_{528/65}$ | 2296 |
| UPF0501 protein KIAA1430 | $_{136}$EESsDDGKKY$_{145}$ | 2297 |
| Xenotropic and polytropic retrovirus receptor 1 | $_{657}$KNRsWKYN$_{664}$ | 2298 |
| | $_{657}$KNRSWKYNQ$_{665}$ | 2299 |
| | $_{657}$KNRsWKYNQSISLR$_{670}$ | 2300 |
| | $_{657}$KNRsWKYNQSISLRRP$_{672}$ | 2301 |
| | $_{658}$NRsWKYNQSISLR$_{670}$ | 2302 |
| | $_{658}$NRsWKYNQSISLRRP$_{672}$ | 2303 |
| | $_{659}$RsWKYNQSISLRRP$_{672}$ | 2304 |

2048-EBV alone

| Source Protein | Phosphopeptide | SEQ ID NO. |
|---|---|---|
| BCL2-associated transcription factor 1 | $_{653}$RRIDIsPSTLR$_{663}$ | 2305 |
| Caspase recruitment domain-containing protein 11 | $_{653}$RRIDIsPSTLRK$_{664}$ | 2306 |
| | $_{509}$RAKsPISLK$_{517}$ | 2307 |
| Chromatin-modifying protein 1a | $_{49/177}$ESsVRSQEDQLSR$_{61/189}$ | 2308 |
| | $_{49/177}$ESsVRSQEDQLSRR$_{62/190}$ | 2309 |
| Interleukin-10 receptor-5 chain | $_{293}$DKLsVIAEDSESGKQ$_{307}$ | 2310 |
| | $_{293}$DKLsVIAEDSESGKQN$_{308}$ | 2311 |
| | $_{293}$DKLsVIAEDSESGKQNP$_{309}$ | 2312 |
| | $_{293}$DKLsVIAEDSESGKQNPG$_{310}$ | 2313 |
| | $_{293}$DKLsVIAEDSESGKQNPGDS$_{312}$ | 2314 |
| | $_{294}$KLsVIAEDSESGKQN$_{308}$ | 2315 |
| | $_{294}$KLsVIAEDSESGKQNP$_{309}$ | 2316 |
| | $_{294}$KLsVIAEDSESGKQNPG$_{310}$ | 2317 |
| NADH-ubiquinone oxidoreductase flavoprotein 3 | $_{88}$NLELSKFRMPQPSSGREsPRH$_{108}$ | 2318 |
| | $_{91}$LSKFRMPQPSSGREsPRH$_{108}$ | 2319 |
| Protein FAM40A | $_{318}$PPLPEDSIKVIRNMRAAsPPA$_{338}$ | 2320 |

TABLE 21-continued

Characteristics of HLA-DR-associated Phosphopeptides Selectively Expressed by EBV-transformed B Cells

| Source Protein | Phosphopeptide | SEQ ID NO. |
|---|---|---|
| Ras association domain containing protein 6 | $_{184/152/140}$RTMsEAALVRK$_{194/162/150}$ | 2321 |
| SH2 domain containing 3C isoform 1 | $_{80}$MPRPsIKKAQNSQAARQ$_{96}$ | 2322 |
| Tax1-binding protein 1, isoform 1 or 2 | $_{106}$THKGEIRGASTPFQFRAssP$_{125}$ | 2323 |
|  | $_{107}$HKGEIRGASTPFQFRAssP$_{125}$ | 2324 |
| UPF0492 protein C20orf94 | $_{391}$STIQNsPTKK$_{400}$ | 2325 |

TABLE 22

Characteristics of HLA-DR-associated Phosphopeptides Commonly Expressed by Melanoma and EBV-B Cells

| Source Protein | Phosphopeptide | SEQ ID NO |
|---|---|---|
| Elongin A | $_{122}$RSYsPDHRQK$_{131}$ | 2326 |
| Ferritin heavy chain | $_{171}$FDKHTLGDsDNES$_{183}$ | 2327 |
| Frizzled-6 | $_{617}$EPAsPAAsISRLsGEQVDGKG$_{637}$ | 2328 |
|  | $_{620}$SPAASISRLsGEQVDGKG$_{637}$ | 2329 |
|  | $_{623}$ASISRLsGEQVDGKG$_{637}$ | 2330 |
|  | $_{623}$AsISRLsGEQVDGKG$_{637}$ | 2331 |
|  | $_{623}$AsISRLsGEQVDGKG$_{637}$ | 2332 |
| Insulin like growth factor 2 receptor | $_{2392}$TTKsVKALSSLHG$_{2404}$ | 2333 |
|  | $_{2392}$TTKsVKALSSLHGDD$_{2406}$ | 2334 |
|  | $_{2392}$TTKsVKALSSLHGDDQ$_{2407}$ | 2335 |
|  | $_{2392}$TTKsVKALSSLHGDDQD$_{2408}$ | 2336 |
|  | $_{2392}$TTKsVKALSSLHGDDQDS$_{2409}$ | 2337 |
|  | $_{2393}$TKsVKALSSLHGDD$_{2406}$ | 2338 |
|  | $_{2393}$TKsVKALSSLHGDDQ$_{2407}$ | 2339 |
|  | $_{2393}$TKsVKALSSLHGDDQD$_{2408}$ | 2340 |
|  | $_{2394}$KsVKALSSLHGDDQ$_{2407}$ | 2341 |
|  | $_{2394}$KsVKALSSLHGDDQD$_{2408}$ | 2342 |
|  | $_{2392}$TTKSVKALSSLHGDDQDsED$_{2411}$ | 2343 |
|  | $_{2392}$TTKSVKALSSLHGDDQDsEDE$_{2412}$ | 2344 |
|  | $_{2394}$KSVKALSSLHGDDQDsEDE$_{2412}$ | 2345 |
|  | $_{2476}$KLVSFHDDsDEDL$_{2488}$ | 2346 |
| Lipolysis-stimulated lipoprotein receptor | $_{324/287/305}$APSTYAHLsPAK$_{335/398/316}$ | 2347 |
|  | $_{324/287/305}$APSTYAHLsPAKTPPPP$_{340/303/321}$ | 2348 |
| Plakophilin-4 | $_{206}$NRAMRRVsSVPSR$_{218}$ | 2349 |
|  | $_{206}$NRAMRRVsSVPSRAQ$_{220}$ | 2350 |
|  | $_{278}$RPAsPtAIRRIGSVTSRQT$_{296}$ | 2351 |
| Sequestosome-1 | $_{332}$sGGDDDWTHLSSKEVDPST$_{350}$ | 2352 |
|  | $_{332}$sGGDDDWTHLSSKEVDPSTG$_{351}$ | 2353 |
|  | $_{332}$sGGDDDWTHLSSKEVDPSTGE$_{352}$ | 2354 |
|  | $_{332}$sGGDDDWTHLSSKEVDPSTGEL$_{353}$ | 2355 |
|  | $_{332}$SGGDDDWTHLSSKEVDPSTGELQ$_{354}$ | 2356 |
|  | $_{333}$GGDDDWTHLsSKEVDPS$_{349}$ | 2357 |
|  | $_{333}$GGDDDWTHLsSKEVDPSTG$_{351}$ | 2358 |
|  | $_{334}$GDDDWTHLsSKEVD$_{347}$ | 2359 |
|  | $_{334}$GDDDWTHLsSKEVDP$_{348}$ | 2360 |
|  | $_{334}$GDDDWTHLsSKEVDPS$_{349}$ | 2361 |
|  | $_{334}$GDDDWTHLsSKEVDPSTG$_{351}$ | 2362 |
|  | $_{335}$DDDWTHLsSKEVDPS$_{349}$ | 2363 |
|  | $_{335}$DDDWTHLsSKEVDPSTG$_{351}$ | 2364 |
|  | $_{336}$DDWTHLsSKEVDPS$_{349}$ | 2365 |
|  | $_{337}$DWTHLsSKEVDPS$_{349}$ | 2366 |
|  | $_{337}$DWTHLsSKEVDPSTG$_{351}$ | 2367 |
|  | $_{338}$WTHLsSKEVDPS$_{349}$ | 2368 |
|  | $_{338}$WTHLsSKEVDPSTG$_{351}$ | 2369 |

TABLE 22-continued

Characteristics of HLA-DR-associated Phosphopeptides
Commonly Expressed by Melanoma and EBV-B Cells

| Source Protein | Phosphopeptide | SEQ ID NO |
|---|---|---|
| Sorting nexin-17 | $_{402}$GtLRRSDSQQAVK$_{414}$ | 2370 |
|  | $_{402}$GtLRRSDSQQAVKS$_{415}$ | 2371 |
|  | $_{402}$GtLRRSDSQQAVKSPP$_{417}$ | 2372 |
| UPF0555 protein KIAA0776 | $_{783}$VLKSRKssVTEE$_{794}$ | 2373 |

TABLE 23

CLL Cohort Characteristics

| Patient ID | Time Since Sample | Age | Stage at Presentation (Binet) | CD38 | Zap-70 | Genetic Aberration? | IgV$_H$ | Days to First Treatment | Progression Free Survival | Timing of Sample(s) | Treatment, Status |
|---|---|---|---|---|---|---|---|---|---|---|---|
| CLL1 | 890 | 79 | A | + | + | Normal | UM | 2387 | Progressed through Chl | Previously treated; slow progressive disease | Died, Chl, FC, Methylpred, died of disease +4695 |
| CLL2 | 420 | 71 | A | − | − | n.d. | n.d. | Untreated | Untreated | Untreated | Alive day +506; Alive, FCR, transformed to Hodgkins |
| CLL3 | 1048 | 64 | A | − | n.d. | n.d. | n.d. | 685 | Progressed 301 days post-1$^{st}$ tx | Untreated | ABVD, day +1142 |
| CLL4 | 945 | 75 | A | − | − | Normal | M | Untreated | Untreated | Untreated | Alive day +5341 |
| CLL5 | 688 | 63 | A | − | n.d. | n.d. | n.d. | Untreated | Untreated | Untreated | Alive day +1749 |
| CLL6 | 586 | 86 | A | − | − | Normal | M | 3334 | Died on tx | Prior to 1$^{st}$ treatment for progressive disease | Died, Chl, died of disease day +3457 |
| CLL7 | 359 | 70 | A | − | − | n.d. | n.d. | Untreated | Untreated | Untreated | Alive day +1201 |
| CLL8 | 359 | 67 | A | − | n.d. | 13q | n.d. | 1141 | Not progressed | Prior to 1$^{st}$ treatment for progressive disease | Alive, FCR, day +1460 |
| CLL9 | 897 | 78 | A | − | − | Normal | M | Untreated | Untreated | Untreated | Alive day +6133 |
| CLL10 | 1091 | 89 | C | n.d. | n.d. | n.d. | n.d. | 0 | Partial response | All taken on treatment (Chl) | Died, Chl, ?died of disease day +362 |
| CLL11 | 540 | 65 | B | − | + | n.d. | n.d. | 30 | Progressed 631 days post-1$^{st}$ tx | Previously treated; progressive disease | Alive, Chl, FCO, day +1399 |
| CLL12 | 1064 | 84 | C | − | − | n.d. | n.d. | 68 | Not progressed | 18 Feb. 2009-prior to 1st treatment for progressive disease 6 Jan. 2010-4 months post-treatment | Alive, Chl/R, day +1129 |
| CLL13 | 523 | 63 | A | − | − | n.d. | n.d. | Untreated | Untreated | 6 Jan. 2010-4 months post-treatment | Alive day +993 |
| CLL14 | 579 | 63 | A | + | − | n.d. | M | Untreated | Untreated | Untreated | Alive day +2708 |

IgVH: immunoglobulin variable region mutation status (M—mutated; UM—unmutated); n.d.: not determined; FC: fludarabine/cyclophosphamide; FCR: fludarabine/cyclophopshamide/rituximab; FCO: fludarabine/cyclophopshamide/ofatumumab; Chl: chlorambucil; Chl/R: chlorambucil/rituximab; Methylpred: methylprednisolone.

TABLE 24

AML Cohort Characteristics

| Patient ID | Age and Gender | Stage at Presentation (Binet) | Genetic Aberration? | Transplant History | ALC | Timing of Sample(s) | Treatment, Status |
|---|---|---|---|---|---|---|---|
| ALL1 | 65M | AML, ADE x2 | Monosomy 7 | MUD April 2009 | 1.2 | 21 months post-8CT | 23 months post-transplant; death due to relapse |
| ALL2 | 67F | AML, DAx3, CR1 | Normal | MUD October 2010 | 1.3 | 13 months post-8CT | 13 months post-transplant; in remission and well |
| ALL3 | 64F | AML, March 2010 DA x2, MIDAC, C | FLT3+ | 2 Cord Bloods | 1.3 | 9 months post-8CT | 13 months post-transplant; in remission, EBV reac |
| ALL4 | 67M | AML, MDAC x 3 CR1 | Normal | Sibling December 2010 | 2.3 | 10 months post-8CT | 10 months post-transplant; relapse |
| ALL5 | 62F | AML, DAx2, MACE | Normal | MUD September 2009 | 1.3 | 21 months post-8CT | 26 months post-transplant; in remission and well |
| ALL6 | 65M | AML, DA/Myelotarg, DA CR1 | Normal | MUD December 2010 | 1.5 | 3 months post-8CT | 3 months post-transplant; death |
| ALL7 | 54F | AML, AML 17 (ADE X2) CR1 | Monosomy 7 | MUD November 2010 | 0.9 | 7 months post-8CT | 13 months post-transplant; in remission and well |
| ALL8 | 56M | MD8 transformed to AMLm [DAx2] | Normal | MUD November 2010 | 1.6 | 6 months post-8CT | 12 months post-transplant; in remission and well |
| ALL9 | 51F | MD8 no treatment | Trisomy 6 | Sibling January 2002 | 2.2 | 113 months post-8CT | 117 months post-transplant; in remission and well |
| ALL10 | 66F | AML [AML 16] [FLAG x2] CR2 | Normal | MUD February 2009 | 2.7 | 34 months post-8CT | 34 months post-transplant; in remission and well |
| ALL11 | 67F | AML, [DA x2, MDAC] [FLAG/Mye] | Normal | 2 Cord Bloods September 2010 | 5.4 | 9 months post-8CT | 13 months post-transplant; in remission and well |
| ALL12 | 41M | AML September 2009, DA x 2, MD | Normal | Sibling May 2010 | 1.8 | 15 months post-8CT | 19 months post-transplant; in remission and well |

MUD, matched unrelated donor; ADE, Ara-C, daunorubicin, etoposide; FLAG, fludarabine, Ara-C, idarubicin; DA, daunorubicin, Ara-c; MIDAC; amsacrine, Ara-C, etoposide, mitozantrone.

SEQUENCE LISTING (2380 sequences)

SEQ ID NO: 1 - protein, 10 aa, Homo sapiens
  SITE (1)..(10): One or more of the listed amino acids can be phosphorylated as set forth in the Tables
ALRSSPIMRK

SEQ ID NO: 2 - protein, 9 aa, Homo sapiens
  SITE (1)..(9): One or more of the listed amino acids can be phosphorylated as set forth in the Tables
ALYSGVHKK

SEQ ID NO: 3 - protein, 10 aa, Homo sapiens
  SITE (1)..(10): One or more of the listed amino acids can be phosphorylated as set forth in the Tables
DTVPLSPLKY

SEQ ID NO: 4 - protein, 10 aa, Homo sapiens
  SITE (1)..(10): One or more of the listed amino acids can be phosphorylated as set forth in the Tables
EMKKSPTSLK

SEQ ID NO: 5 - protein, 9 aa, Homo sapiens
  SITE (1)..(9): One or more of the listed amino acids can be phosphorylated as set forth in the Tables
FRYSGKTEY

SEQ ID NO: 6 - protein, 13 aa, Homo sapiens
  SITE (1)..(13): One or more of the listed amino acids can be phosphorylated as set forth in the Tables
FVSKVMIGSPKKV

SEQ ID NO: 7 - protein, 9 aa, Homo sapiens
  SITE (1)..(9): One or more of the listed amino acids can be phosphorylated as set forth in the Tables
IISSPLTGK

SEQ ID NO: 8 - protein, 9 aa, Homo sapiens
  SITE (1)..(9): One or more of the listed amino acids can be phosphorylated as set forth in the Tables
ITQGTPLKY

SEQ ID NO: 9 - protein, 11 aa, Homo sapiens
  SITE (1)..(11): One or more of the listed amino acids can be phosphorylated as set forth in the Tables
KGISSSSLKEK

SEQ ID NO: 10 - protein, 10 aa, Homo sapiens
  SITE (1)..(10): One or more of the listed amino acids can be phosphorylated as set forth in the Tables
KIDSPTKVKK

SEQ ID NO: 11 - protein, 9 aa, Homo sapiens
  SITE (1)..(9): One or more of the listed amino acids can be phosphorylated as set forth in the Tables
KIFSKQQGK

SEQ ID NO: 12 - protein, 10 aa, Homo sapiens
  SITE (1)..(10): One or more of the listed amino acids can be phosphorylated as set forth in the Tables
KIRSSPREAK

SEQ ID NO: 13 - protein, 9 aa, Homo sapiens
  SITE (1)..(9): One or more of the listed amino acids can be phosphorylated as set forth in the Tables
KIRTSPTFR

SEQ ID NO: 14 - protein, 9 aa, Homo sapiens
  SITE (1)..(9): One or more of the listed amino acids can be phosphorylated as set forth in the Tables
KLFSPAHKK

SEQ ID NO: 15 - protein, 9 aa, Homo sapiens
  SITE (1)..(9): One or more of the listed amino acids can be phosphorylated as set forth in the Tables
KLRSPFLQK

SEQ ID NO: 16 - protein, 11 aa, Homo sapiens
  SITE (1)..(11): One or more of the listed amino acids can be phosphorylated as set forth in the Tables
KLSSPRGGMKK

SEQ ID NO: 17 - protein, 10 aa, Homo sapiens
  SITE (1)..(10): One or more of the listed amino acids can be phosphorylated as set forth in the Tables
KMPTTPVKAK

SEQ ID NO: 18 - protein, 9 aa, Homo sapiens
  SITE (1)..(9): One or more of the listed amino acids can be phosphorylated as set forth in the Tables
KRLSVERIY

SEQ ID NO: 19 - protein, 9 aa, Homo sapiens
  SITE (1)..(9): One or more of the listed amino acids can be phosphorylated as set forth in the Tables
KRFSGTVRL

SEQ ID NO: 20 - protein, 9 aa, Homo sapiens
  SITE (1)..(9): One or more of the listed amino acids can be phosphorylated as set forth in the Tables
KRYSGNMEY

SEQ ID NO: 21 - protein, 11 aa, Homo sapiens
  SITE (1)..(11): One or more of the listed amino acids can be phosphorylated as set forth in the Tables
KSKSNPDFLKK

SEQ ID NO: 22 - protein, 9 aa, Homo sapiens
  SITE (1)..(9): One or more of the listed amino acids can be phosphorylated as set forth in the Tables
KSKTPLVAR

SEQ ID NO: 23 - protein, 10 aa, Homo sapiens
  SITE (1)..(10): One or more of the listed amino acids can be phosphorylated as set forth in the Tables
KSSSLGNLKK

SEQ ID NO: 24 - protein, 12 aa, Homo sapiens
  SITE (1)..(12): One or more of the listed amino acids can be phosphorylated as set forth in the Tables
KTLSPGKNGVVK

SEQ ID NO: 25 - protein, 10 aa, Homo sapiens
  SITE (1)..(10): One or more of the listed amino acids can be phosphorylated as set forth in the Tables
KTPTSPLKMK

SEQ ID NO: 26 - protein, 11 aa, Homo sapiens
  SITE (1)..(11): One or more of the listed amino acids can be phosphorylated as set forth in the Tables
KVHGSLARAGK

SEQ ID NO: 27 - protein, 9 aa, Homo sapiens
  SITE (1)..(9): One or more of the listed amino acids can be phosphorylated as set forth in the Tables
KVLTPIKEK

SEQ ID NO: 28 - protein, 11 aa, Homo sapiens
  SITE (1)..(11): One or more of the listed amino acids can be phosphorylated as set forth in the Tables
KVHGSLARAGK

SEQ ID NO: 29 - protein, 10 aa, Homo sapiens
  SITE (1)..(10): One or more of the listed amino acids can be phosphorylated as set forth in the Tables
LLNKSSPVKK

SEQ ID NO: 30 - protein, 10 aa, Homo sapiens
  SITE (1)..(10): One or more of the listed amino acids can be phosphorylated as set forth in the Tables
MTRSPPRVSK

SEQ ID NO: 31 - protein, 9 aa, Homo sapiens
  SITE (1)..(9): One or more of the listed amino acids can be phosphorylated as set forth in the Tables
NYVERKNSL

SEQ ID NO: 32 - protein, 10 aa, Homo sapiens
  SITE (1)..(10): One or more of the listed amino acids can be phosphorylated as set forth in the Tables
QVFSPKKGQK

SEQ ID NO: 33 - protein, 10 aa, Homo sapiens
  SITE (1)..(10): One or more of the listed amino acids can be phosphorylated as set forth in the Tables
RAFSFSKTPK

SEQ ID NO: 34 - protein, 10 aa, Homo sapiens
  SITE (1)..(10): One or more of the listed amino acids can be phosphorylated as set forth in the Tables
RILSPSMASK

SEQ ID NO: 35 - protein, 9 aa, Homo sapiens
  SITE (1)..(9): One or more of the listed amino acids can be phosphorylated as set forth in the Tables
RIYQYIQSR

SEQ ID NO: 36 - protein, 9 aa, Homo sapiens
  SITE (1)..(9): One or more of the listed amino acids can be phosphorylated as set forth in the Tables
RIQYIQSRF

SEQ ID NO: 37 - protein, 10 aa, Homo sapiens
  SITE (1)..(10): One or more of the listed amino acids can be phosphorylated as set forth in the Tables
RIQYIQSRFY

SEQ ID NO: 38 - protein, 9 aa, Homo sapiens
  SITE (1)..(9): One or more of the listed amino acids can be phosphorylated as set forth in the Tables
RKLSVILIL

SEQ ID NO: 39 - protein, 9 aa, Homo sapiens
  SITE (1)..(9): One or more of the listed amino acids can be phosphorylated as set forth in the Tables
RLISPYKKK

SEQ ID NO: 40 - protein, 9 aa, Homo sapiens
  SITE (1)..(9): One or more of the listed amino acids can be phosphorylated as set forth in the Tables
RLKSPFRKK

SEQ ID NO: 41 - protein, 12 aa, Homo sapiens
  SITE (1)..(12): One or more of the listed amino acids can be phosphorylated as set forth in the Tables
RLLDRSPSRSAK

SEQ ID NO: 42 - protein, 9 aa, Homo sapiens
  SITE (1)..(9): One or more of the listed amino acids can be phosphorylated as set forth in the Tables
RLPSSTLKR

SEQ ID NO: 43 - protein, 10 aa, Homo sapiens
  SITE (1)..(10): One or more of the listed amino acids can be phosphorylated as set forth in the Tables
RLRSAGAAQK

SEQ ID NO: 44 - protein, 9 aa, Homo sapiens
  SITE (1)..(9): One or more of the listed amino acids can be phosphorylated as set forth in the Tables
RLSSPISKR

SEQ ID NO: 45 - protein, 9 aa, Homo sapiens
  SITE (1)..(9): One or more of the listed amino acids can be phosphorylated as set forth in the Tables
RLSSPVLHR

SEQ ID NO: 46 - protein, 9 aa, Homo sapiens
  SITE (1)..(9): One or more of the listed amino acids can be phosphorylated as set forth in the Tables
RLSSRYSQK

SEQ ID NO: 47 - protein, 9 aa, Homo sapiens
  SITE (1)..(9): One or more of the listed amino acids can be phosphorylated as set forth in the Tables
RMYSKSRDH

SEQ ID NO: 48 - protein, 9 aa, Homo sapiens
  SITE (1)..(9): One or more of the listed amino acids can be phosphorylated as set forth in the Tables
RRPSLVHGY

SEQ ID NO: 49 - protein, 11 aa, Homo sapiens
  SITE (1)..(11): One or more of the listed amino acids can be phosphorylated as set forth in the Tables
RSASSATQVHK

SEQ ID NO: 50 - protein, 9 aa, Homo sapiens
  SITE (1)..(9): One or more of the listed amino acids can be phosphorylated as set forth in the Tables
RSLSVEIVY

SEQ ID NO: 51 - protein, 9 aa, Homo sapiens
  SITE (1)..(9): One or more of the listed amino acids can be phosphorylated as set forth in the Tables
RSMSMPVAH

SEQ ID NO: 52 - protein, 9 aa, Homo sapiens
  SITE (1)..(9): One or more of the listed amino acids can be phosphorylated as set forth in the Tables
RSRRSPLLK

SEQ ID NO: 53 - protein, 10 aa, Homo sapiens
  SITE (1)..(10): One or more of the listed amino acids can be phosphorylated as set forth in the Tables
RSRSPPPVSK

SEQ ID NO: 54 - protein, 10 aa, Homo sapiens
  SITE (1)..(10): One or more of the listed amino acids can be phosphorylated as set forth in the Tables
RSRTSPITRR

SEQ ID NO: 55 - protein, 9 aa, Homo sapiens
  SITE (1)..(9): One or more of the listed amino acids can be phosphorylated as set forth in the Tables
RSSSLIRHK

SEQ ID NO: 56 - protein, 9 aa, Homo sapiens
  SITE (1)..(9): One or more of the listed amino acids can be phosphorylated as set forth in the Tables
RSVSLSMRK

SEQ ID NO: 57 - protein, 9 aa, Homo sapiens
  SITE (1)..(9): One or more of the listed amino acids can be phosphorylated as set forth in the Tables
RSYSGSRSR

SEQ ID NO: 58 - protein, 10 aa, Homo sapiens
  SITE (1)..(10): One or more of the listed amino acids can be phosphorylated as set forth in the Tables
RSYSPDHRQK

SEQ ID NO: 59 - protein, 9 aa, Homo sapiens
  SITE (1)..(9): One or more of the listed amino acids can be phosphorylated as set forth in the Tables
RSYSPERSK

SEQ ID NO: 60 - protein, 9 aa, Homo sapiens
  SITE (1)..(9): One or more of the listed amino acids can be phosphorylated as set forth in the Tables
RSYSPRNSR

SEQ ID NO: 61 - protein, 9 aa, Homo sapiens
  SITE (1)..(9): One or more of the listed amino acids can be phosphorylated as set forth in the Tables
RSYSYPRQK

SEQ ID NO: 62 - protein, 14 aa, Homo sapiens
  SITE (1)..(14): One or more of the listed amino acids can be phosphorylated as set forth in the Tables
RSYVTTSTRTYSLG

SEQ ID NO: 63 - protein, 10 aa, Homo sapiens
  SITE (1)..(10): One or more of the listed amino acids can be phosphorylated as set forth in the Tables
RTPSFLKKNK

SEQ ID NO: 64 - protein, 9 aa, Homo sapiens
  SITE (1)..(9): One or more of the listed amino acids can be phosphorylated as set forth in the Tables
RTYKSPLRH

SEQ ID NO: 65 - protein, 10 aa, Homo sapiens
  SITE (1)..(10): One or more of the listed amino acids can be phosphorylated as set forth in the Tables
RVASPTSGVK

SEQ ID NO: 66 - protein, 11 aa, Homo sapiens
  SITE (1)..(11): One or more of the listed amino acids can be phosphorylated as set forth in the Tables
RVASPTSGVKR

SEQ ID NO: 67 - protein, 10 aa, Homo sapiens
  SITE (1)..(10): One or more of the listed amino acids can be phosphorylated as set forth in the Tables
RVKLPSGSKK

SEQ ID NO: 68 - protein, 11 aa, Homo sapiens
  SITE (1)..(11): One or more of the listed amino acids can be phosphorylated as set forth in the Tables
RVKSPGSGHVK

SEQ ID NO: 69 - protein, 11 aa, Homo sapiens
  SITE (1)..(11): One or more of the listed amino acids can be phosphorylated as set forth in the Tables
RVKSPSPKSER

SEQ ID NO: 70 - protein, 11 aa, Homo sapiens
  SITE (1)..(11): One or more of the listed amino acids can be phosphorylated as set forth in the Tables
RVKTPTSQSYR

SEQ ID NO: 71 - protein, 9 aa, Homo sapiens
  SITE (1)..(9): One or more of the listed amino acids can be phosphorylated as set forth in the Tables
RVKTTPLRR

SEQ ID NO: 72 - protein, 10 aa, Homo sapiens
  SITE (1)..(10): One or more of the listed amino acids can be phosphorylated as set forth in the Tables
RVRQSPLATR

SEQ ID NO: 73 - protein, 9 aa, Homo sapiens
  SITE (1)..(9): One or more of the listed amino acids can be phosphorylated as set forth in the Tables
RVYSPYNHR

SEQ ID NO: 74 - protein, 9 aa, Homo sapiens
  SITE (1)..(9): One or more of the listed amino acids can be phosphorylated as set forth in the Tables
SLFSPRRNK

SEQ ID NO: 75 - protein, 11 aa, Homo sapiens
  SITE (1)..(11): One or more of the listed amino acids can be phosphorylated as set forth in the Tables
SLLNKSSPVKK

SEQ ID NO: 76 - protein, 9 aa, Homo sapiens
  SITE (1)..(9): One or more of the listed amino acids can be phosphorylated as set forth in the Tables
SLMSPGRRK

SEQ ID NO: 77 - protein, 9 aa, Homo sapiens
  SITE (1)..(9): One or more of the listed amino acids can be phosphorylated as set forth in the Tables
SVKSPVTVK

SEQ ID NO: 78 - protein, 9 aa, Homo sapiens
  SITE (1)..(9): One or more of the listed amino acids can be phosphorylated as set forth in the Tables
SVRRSVLMK

SEQ ID NO: 79 - protein, 9 aa, Homo sapiens
  SITE (1)..(9): One or more of the listed amino acids can be phosphorylated as set forth in the Tables
SVYSPVKKK

SEQ ID NO: 80 - protein, 9 aa, Homo sapiens
  SITE (1)..(9): One or more of the listed amino acids can be phosphorylated as set forth in the Tables
VMIGSPKKV

SEQ ID NO: 81 - protein, 12 aa, Homo sapiens
  SITE (1)..(12): One or more of the listed amino acids can be phosphorylated as set forth in the Tables
VSKVMIGSPKKV

SEQ ID NO: 82 - protein, 10 aa, Homo sapiens
  SITE (1)..(10): One or more of the listed amino acids can be phosphorylated as set forth in the Tables
VTQTPPYVKK

SEQ ID NO: 83 - protein, 11 aa, Homo sapiens
  SITE (1)..(11): One or more of the listed amino acids can be phosphorylated as set forth in the Tables
AEEEIGTPRKF

SEQ ID NO: 84 - protein, 10 aa, Homo sapiens
  SITE (1)..(10): One or more of the listed amino acids can be phosphorylated as set forth in the Tables
DTVPLSPLKY

SEQ ID NO: 85 - protein, 8 aa, Homo sapiens
  SITE (1)..(8): One or more of the listed amino acids can be phosphorylated as set forth in the Tables
ESESLPRY

SEQ ID NO: 86 - protein, 8 aa, Homo sapiens
  SITE (1)..(8): One or more of the listed amino acids can be phosphorylated as set forth in the Tables
FIESPSKL

SEQ ID NO: 87 - protein, 10 aa, Homo sapiens
  SITE (1)..(10): One or more of the listed amino acids can be phosphorylated as set forth in the Tables
FSSSHEGFSY

SEQ ID NO: 88 - protein, 10 aa, Homo sapiens
  SITE (1)..(10): One or more of the listed amino acids can be phosphorylated as set forth in the Tables
FSSSHEGFSY

SEQ ID NO: 89 - protein, 11 aa, Homo sapiens
  SITE (1)..(11): One or more of the listed amino acids can be phosphorylated as set forth in the Tables
GEESSDDGKKY

SEQ ID NO: 90 - protein, 6 aa, Homo sapiens
  SITE (1)..(6): One or more of the listed amino acids can be phosphorylated as set forth in the Tables
GTLPKY

SEQ ID NO: 91 - protein, 9 aa, Homo sapiens
  SITE (1)..(9): One or more of the listed amino acids can be phosphorylated as set forth in the Tables
IIETPHKEI

SEQ ID NO: 92 - protein, 9 aa, Homo sapiens
  SITE (1)..(9): One or more of the listed amino acids can be phosphorylated as set forth in the Tables
ISFSAHTDY

SEQ ID NO: 93 - protein, 9 aa, Homo sapiens
  SITE (1)..(9): One or more of the listed amino acids can be phosphorylated as set forth in the Tables
ISSSMHSLY

SEQ ID NO: 94 - protein, 9 aa, Homo sapiens
  SITE (1)..(9): One or more of the listed amino acids can be phosphorylated as set forth in the Tables
ITQGTPLKY

SEQ ID NO: 95 - protein, 7 aa, Homo sapiens
  SITE (1)..(7): One or more of the listed amino acids can be phosphorylated as set forth in the Tables
IVRYHQL

SEQ ID NO: 96 - protein, 8 aa, Homo sapiens
  SITE (1)..(8): One or more of the listed amino acids can be phosphorylated as set forth in the Tables
IVTDRDPL

SEQ ID NO: 97 - protein, 9 aa, Homo sapiens
  SITE (1)..(9): One or more of the listed amino acids can be phosphorylated as set forth in the Tables
KSESRQERY

SEQ ID NO: 98 - protein, 10 aa, Homo sapiens
  SITE (1)..(10): One or more of the listed amino acids can be phosphorylated as set forth in the Tables
LLDPSRSYSY

SEQ ID NO: 99 - protein, 10 aa, Homo sapiens
  SITE (1)..(10): One or more of the listed amino acids can be phosphorylated as set forth in the Tables
LLDTPVKTQY

SEQ ID NO: 100 - protein, 10 aa, Homo sapiens
  SITE (1)..(10): One or more of the listed amino acids can be phosphorylated as set forth in the Tables
LSDSDTEAKL

SEQ ID NO: 101 - protein, 9 aa, Homo sapiens
  SITE (1)..(9): One or more of the listed amino acids can be phosphorylated as set forth in the Tables
MTDTYRLKY

SEQ ID NO: 102 - protein, 8 aa, Homo sapiens
  SITE (1)..(8): One or more of the listed amino acids can be phosphorylated as set forth in the Tables
NTDSPLRY

SEQ ID NO: 103 - protein, 10 aa, Homo sapiens
  SITE (1)..(10): One or more of the listed amino acids can be phosphorylated as set forth in the Tables
QLDSPQRALY

SEQ ID NO: 104 - protein, 9 aa, Homo sapiens
  SITE (1)..(9): One or more of the listed amino acids can be phosphorylated as set forth in the Tables
RGDSPKIDL

SEQ ID NO: 105 - protein, 9 aa, Homo sapiens
  SITE (1)..(9): One or more of the listed amino acids can be phosphorylated as set forth in the Tables
RRLSFLVSY

SEQ ID NO: 106 - protein, 9 aa, Homo sapiens
  SITE (1)..(9): One or more of the listed amino acids can be phosphorylated as set forth in the Tables
RSDSRAQAV

SEQ ID NO: 107 - protein, 11 aa, Homo sapiens
  SITE (1)..(11): One or more of the listed amino acids can be phosphorylated as set forth in the Tables
RSDSYVELSQY

SEQ ID NO: 108 - protein, 9 aa, Homo sapiens
  SITE (1)..(9): One or more of the listed amino acids can be phosphorylated as set forth in the Tables
RSISVGENL

SEQ ID NO: 109 - protein, 13 aa, Homo sapiens
  SITE (1)..(13): One or more of the listed amino acids can be phosphorylated as set forth in the Tables
RTEPSKSPGSLRY

SEQ ID NO: 110 - protein, 8 aa, Homo sapiens
  SITE (1)..(8): One or more of the listed amino acids can be phosphorylated as set forth in the Tables
SIDSPQKL

SEQ ID NO: 111 - protein, 10 aa, Homo sapiens
  SITE (1)..(10): One or more of the listed amino acids can be phosphorylated as set forth in the Tables
SLDSPSYVLY

SEQ ID NO: 112 - protein, 8 aa, Homo sapiens
  SITE (1)..(8): One or more of the listed amino acids can be phosphorylated as set forth in the Tables
SREKHSEI

SEQ ID NO: 113 - protein, 10 aa, Homo sapiens
  SITE (1)..(10): One or more of the listed amino acids can be phosphorylated as set forth in the Tables
SSDPASQLSY

SEQ ID NO: 114 - protein, 10 aa, Homo sapiens
  SITE (1)..(10): One or more of the listed amino acids can be phosphorylated as set forth in the Tables
SSDSPTNHFF

SEQ ID NO: 115 - protein, 9 aa, Homo sapiens
  SITE (1)..(9): One or more of the listed amino acids can be phosphorylated as set forth in the Tables
STDSETLRY

SEQ ID NO: 116 - protein, 9 aa, Homo sapiens
  SITE (1)..(9): One or more of the listed amino acids can be phosphorylated as set forth in the Tables
SVDISPTRL

SEQ ID NO: 117 - protein, 10 aa, Homo sapiens
  SITE (1)..(10): One or more of the listed amino acids can be phosphorylated as set forth in the Tables
TMASPGKDNY

SEQ ID NO: 118 - protein, 11 aa, Homo sapiens
  SITE (1)..(11): One or more of the listed amino acids can be phosphorylated as set forth in the Tables
TSETPDYLLKY

SEQ ID NO: 119 - protein, 12 aa, Homo sapiens
  SITE (1)..(12): One or more of the listed amino acids can be phosphorylated as set forth in the Tables
VSKVMIGSPKKV

SEQ ID NO: 120 - protein, 11 aa, Homo sapiens
  SITE (1)..(11): One or more of the listed amino acids can be phosphorylated as set forth in the Tables
AEEEIGTPRKF

SEQ ID NO: 121 - protein, 10 aa, Homo sapiens
  SITE (1)..(10): One or more of the listed amino acids can be phosphorylated as set forth in the Tables
AENSPTRQQF

SEQ ID NO: 122 - protein, 11 aa, Homo sapiens
  SITE (1)..(11): One or more of the listed amino acids can be phosphorylated as set forth in the Tables
AESSPTAGKKL

SEQ ID NO: 123 - protein, 9 aa, Homo sapiens
  SITE (1)..(9): One or more of the listed amino acids can be phosphorylated as set forth in the Tables
ATAGPRLGW

SEQ ID NO: 124 - protein, 9 aa, Homo sapiens
  SITE (1)..(9): One or more of the listed amino acids can be phosphorylated as set forth in the Tables
DERLRINSL

SEQ ID NO: 125 - protein, 9 aa, Homo sapiens
  SITE (1)..(9): One or more of the listed amino acids can be phosphorylated as set forth in the Tables
DQFERIKTL

SEQ ID NO: 126 - protein, 9 aa, Homo sapiens
  SITE (1)..(9): One or more of the listed amino acids can be phosphorylated as set forth in the Tables
DQISHRASL

SEQ ID NO: 127 - protein, 10 aa, Homo sapiens
  SITE (1)..(10): One or more of the listed amino acids can be phosphorylated as set forth in the Tables
EESSDDGKKY

SEQ ID NO: 128 - protein, 10 aa, Homo sapiens
  SITE (1)..(10): One or more of the listed amino acids can be phosphorylated as set forth in the Tables
EESSDDGKKY

SEQ ID NO: 129 - protein, 11 aa, Homo sapiens
  SITE (1)..(11): One or more of the listed amino acids can be phosphorylated as set forth in the Tables
GEESSDDGKKY

SEQ ID NO: 130 - protein, 9 aa, Homo sapiens
  SITE (1)..(9): One or more of the listed amino acids can be phosphorylated as set forth in the Tables
KEMSPTRQL

SEQ ID NO: 131 - protein, 9 aa, Homo sapiens
  SITE (1)..(9): One or more of the listed amino acids can be phosphorylated as set forth in the Tables
RQKSPLFQF

SEQ ID NO: 132 - protein, 9 aa, Homo sapiens
  SITE (1)..(9): One or more of the listed amino acids can be phosphorylated as set forth in the Tables
SEGSLHRKY

SEQ ID NO: 133 - protein, 11 aa, Homo sapiens
  SITE (1)..(11): One or more of the listed amino acids can be phosphorylated as set forth in the Tables
ARFSPDDKYSR

SEQ ID NO: 134 - protein, 9 aa, Homo sapiens
  SITE (1)..(9): One or more of the listed amino acids can be phosphorylated as set forth in the Tables
FRYSGKTEY

SEQ ID NO: 135 - protein, 9 aa, Homo sapiens
  SITE (1)..(9): One or more of the listed amino acids can be phosphorylated as set forth in the Tables
GRKSPPPSF

SEQ ID NO: 136 - protein, 9 aa, Homo sapiens
  SITE (1)..(9): One or more of the listed amino acids can be phosphorylated as set forth in the Tables
GRLGSPHRR

SEQ ID NO: 137 - protein, 11 aa, Homo sapiens
  SITE (1)..(11): One or more of the listed amino acids can be phosphorylated as set forth in the Tables
GRLSPKASQVK

SEQ ID NO: 138 - protein, 10 aa, Homo sapiens
  SITE (1)..(10): One or more of the listed amino acids can be phosphorylated as set forth in the Tables
GRLSPVPVPR

SEQ ID NO: 139 - protein, 11 aa, Homo sapiens
  SITE (1)..(11): One or more of the listed amino acids can be phosphorylated as set forth in the Tables
GRSSTASLVKR

SEQ ID NO: 140 - protein, 10 aa, Homo sapiens
  SITE (1)..(10): One or more of the listed amino acids can be phosphorylated as set forth in the Tables
HRLSPVKGEF

SEQ ID NO: 141 - protein, 11 aa, Homo sapiens
  SITE (1)..(11): One or more of the listed amino acids can be phosphorylated as set forth in the Tables
HRNSNPVIAEL

SEQ ID NO: 142 - protein, 10 aa, Homo sapiens
  SITE (1)..(10): One or more of the listed amino acids can be phosphorylated as set forth in the Tables
KRASGQAFEL

SEQ ID NO: 143 - protein, 9 aa, Homo sapiens
  SITE (1)..(9): One or more of the listed amino acids can be phosphorylated as set forth in the Tables
KRASFAKSV

SEQ ID NO: 144 - protein, 9 aa, Homo sapiens
  SITE (1)..(9): One or more of the listed amino acids can be phosphorylated as set forth in the Tables
KRASSPFRR

SEQ ID NO: 145 - protein, 9 aa, Homo sapiens
  SITE (1)..(9): One or more of the listed amino acids can be phosphorylated as set forth in the Tables
KRASVFVKL

SEQ ID NO: 146 - protein, 7 aa, Homo sapiens
  SITE (1)..(7): One or more of the listed amino acids can be phosphorylated as set forth in the Tables
KRFSFKK

SEQ ID NO: 147 - protein, 9 aa, Homo sapiens
  SITE (1)..(9): One or more of the listed amino acids can be phosphorylated as set forth in the Tables
KRFSFKKSF

SEQ ID NO: 148 - protein, 9 aa, Homo sapiens
  SITE (1)..(9): One or more of the listed amino acids can be phosphorylated as set forth in the Tables
KRFSGTVRL

SEQ ID NO: 149 - protein, 9 aa, Homo sapiens
  SITE (1)..(9): One or more of the listed amino acids can be phosphorylated as set forth in the Tables
KRLSPAPQL

SEQ ID NO: 150 - protein, 9 aa, Homo sapiens
  SITE (1)..(9): One or more of the listed amino acids can be phosphorylated as set forth in the Tables
KRLSVERIY

SEQ ID NO: 151 - protein, 8 aa, Homo sapiens
  SITE (1)..(8): One or more of the listed amino acids can be phosphorylated as set forth in the Tables
KRMSPKPL

SEQ ID NO: 152 - protein, 9 aa, Homo sapiens
  SITE (1)..(9): One or more of the listed amino acids can be phosphorylated as set forth in the Tables
KRYSGNMEY

SEQ ID NO: 153 - protein, 9 aa, Homo sapiens
  SITE (1)..(9): One or more of the listed amino acids can be phosphorylated as set forth in the Tables
MRLSRELQL

SEQ ID NO: 154 - protein, 10 aa, Homo sapiens
  SITE (1)..(10): One or more of the listed amino acids can be phosphorylated as set forth in the Tables
NRYTNRVVTL

SEQ ID NO: 155 - protein, 9 aa, Homo sapiens
  SITE (1)..(9): One or more of the listed amino acids can be phosphorylated as set forth in the Tables
RRFSPPRRM

SEQ ID NO: 156 - protein, 9 aa, Homo sapiens
  SITE (1)..(9): One or more of the listed amino acids can be phosphorylated as set forth in the Tables
RRFSRSPIR

SEQ ID NO: 157 - protein, 9 aa, Homo sapiens
  SITE (1)..(9): One or more of the listed amino acids can be phosphorylated as set forth in the Tables
RRFSRSPIR

SEQ ID NO: 158 - protein, 10 aa, Homo sapiens
  SITE (1)..(10): One or more of the listed amino acids can be phosphorylated as set forth in the Tables
RRFSRSPIRR

SEQ ID NO: 159 - protein, 10 aa, Homo sapiens
  SITE (1)..(10): One or more of the listed amino acids can be phosphorylated as set forth in the Tables
RRFSRSPIRR

SEQ ID NO: 160 - protein, 9 aa, Homo sapiens
  SITE (1)..(9): One or more of the listed amino acids can be phosphorylated as set forth in the Tables
RRISGVDRY

SEQ ID NO: 161 - protein, 10 aa, Homo sapiens
  SITE (1)..(10): One or more of the listed amino acids can be phosphorylated as set forth in the Tables
RRISGVDRYY

SEQ ID NO: 162 - protein, 9 aa, Homo sapiens
  SITE (1)..(9): One or more of the listed amino acids can be phosphorylated as set forth in the Tables
RRKSQLDSL

SEQ ID NO: 163 - protein, 9 aa, Homo sapiens
  SITE (1)..(9): One or more of the listed amino acids can be phosphorylated as set forth in the Tables
RRKSQVAEL

SEQ ID NO: 164 - protein, 9 aa, Homo sapiens
  SITE (1)..(9): One or more of the listed amino acids can be phosphorylated as set forth in the Tables
RRLSADIRL

SEQ ID NO: 165 - protein, 9 aa, Homo sapiens
  SITE (1)..(9): One or more of the listed amino acids can be phosphorylated as set forth in the Tables
RRLSFLVSY

SEQ ID NO: 166 - protein, 10 aa, Homo sapiens
  SITE (1)..(10): One or more of the listed amino acids can be phosphorylated as set forth in the Tables
RRLSGGSHSY

SEQ ID NO: 167 - protein, 10 aa, Homo sapiens
  SITE (1)..(10): One or more of the listed amino acids can be phosphorylated as set forth in the Tables
RRLSGPLHTL

SEQ ID NO: 168 - protein, 9 aa, Homo sapiens
  SITE (1)..(9): One or more of the listed amino acids can be phosphorylated as set forth in the Tables
RRMSLLSVV

SEQ ID NO: 169 - protein, 9 aa, Homo sapiens
  SITE (1)..(9): One or more of the listed amino acids can be phosphorylated as set forth in the Tables
RRNSSERTL

SEQ ID NO: 170 - protein, 9 aa, Homo sapiens
  SITE (1)..(9): One or more of the listed amino acids can be phosphorylated as set forth in the Tables
RRNSSIVGR

SEQ ID NO: 171 - protein, 10 aa, Homo sapiens
  SITE (1)..(10): One or more of the listed amino acids can be phosphorylated as set forth in the Tables
RRNSVFQQGM

SEQ ID NO: 172 - protein, 9 aa, Homo sapiens
  SITE (1)..(9): One or more of the listed amino acids can be phosphorylated as set forth in the Tables
RRPSLVHGY

SEQ ID NO: 173 - protein, 9 aa, Homo sapiens
  SITE (1)..(9): One or more of the listed amino acids can be phosphorylated as set forth in the Tables
RRPSVFERL

SEQ ID NO: 174 - protein, 9 aa, Homo sapiens
  SITE (1)..(9): One or more of the listed amino acids can be phosphorylated as set forth in the Tables
RRPSYRKIL

SEQ ID NO: 175 - protein, 9 aa, Homo sapiens
  SITE (1)..(9): One or more of the listed amino acids can be phosphorylated as set forth in the Tables
RRPSYTLGM

SEQ ID NO: 176 - protein, 9 aa, Homo sapiens
  SITE (1)..(9): One or more of the listed amino acids can be phosphorylated as set forth in the Tables
RRSSFLQVF

SEQ ID NO: 177 - protein, 9 aa, Homo sapiens
  SITE (1)..(9): One or more of the listed amino acids can be phosphorylated as set forth in the Tables
RRSSIGLRV

SEQ ID NO: 178 - protein, 9 aa, Homo sapiens
  SITE (1)..(9): One or more of the listed amino acids can be phosphorylated as set forth in the Tables
RRSSIQSTF

SEQ ID NO: 179 - protein, 9 aa, Homo sapiens
  SITE (1)..(9): One or more of the listed amino acids can be phosphorylated as set forth in the Tables
RRSSQSWSL

SEQ ID NO: 180 - protein, 9 aa, Homo sapiens
  SITE (1)..(9): One or more of the listed amino acids can be phosphorylated as set forth in the Tables
RRSSVDLGL

SEQ ID NO: 181 - protein, 9 aa, Homo sapiens
  SITE (1)..(9): One or more of the listed amino acids can be phosphorylated as set forth in the Tables
RRSSVDLGL

SEQ ID NO: 182 - protein, 9 aa, Homo sapiens
  SITE (1)..(9): One or more of the listed amino acids can be phosphorylated as set forth in the Tables
RRSSVKVEA

SEQ ID NO: 183 - protein, 9 aa, Homo sapiens
  SITE (1)..(9): One or more of the listed amino acids can be phosphorylated as set forth in the Tables
RRVVQRSSL

SEQ ID NO: 184 - protein, 9 aa, Homo sapiens
  SITE (1)..(9): One or more of the listed amino acids can be phosphorylated as set forth in the Tables
RRYSPPIQR

SEQ ID NO: 185 - protein, 8 aa, Homo sapiens
  SITE (1)..(8): One or more of the listed amino acids can be phosphorylated as set forth in the Tables
SRLTHLSL

SEQ ID NO: 186 - protein, 9 aa, Homo sapiens
  SITE (1)..(9): One or more of the listed amino acids can be phosphorylated as set forth in the Tables
SRMSPKAQR

SEQ ID NO: 187 - protein, 9 aa, Homo sapiens
  SITE (1)..(9): One or more of the listed amino acids can be phosphorylated as set forth in the Tables
SRTSPITRR

SEQ ID NO: 188 - protein, 10 aa, Homo sapiens
  SITE (1)..(10): One or more of the listed amino acids can be phosphorylated as set forth in the Tables
SRYSRSPYSR

SEQ ID NO: 189 - protein, 10 aa, Homo sapiens
  SITE (1)..(10): One or more of the listed amino acids can be phosphorylated as set forth in the Tables
SRYSRSPYSR

SEQ ID NO: 190 - protein, 10 aa, Homo sapiens
  SITE (1)..(10): One or more of the listed amino acids can be phosphorylated as set forth in the Tables
SRYSRSPYSR

SEQ ID NO: 191 - protein, 9 aa, Homo sapiens
  SITE (1)..(9): One or more of the listed amino acids can be phosphorylated as set forth in the Tables
MRLSRELQL

SEQ ID NO: 192 - protein, 9 aa, Homo sapiens
  SITE (1)..(9): One or more of the listed amino acids can be phosphorylated as set forth in the Tables
RSISVGENL

SEQ ID NO: 193 - protein, 8 aa, Homo sapiens
  SITE (1)..(8): One or more of the listed amino acids can be phosphorylated as set forth in the Tables
RSRSPLEL

SEQ ID NO: 194 - protein, 9 aa, Homo sapiens
  SITE (1)..(9): One or more of the listed amino acids can be phosphorylated as set forth in the Tables
SPFKRQLSL

SEQ ID NO: 195 - protein, 8 aa, Homo sapiens
  SITE (1)..(8): One or more of the listed amino acids can be phosphorylated as set forth in the Tables
SRLTHLSL

SEQ ID NO: 196 - protein, 9 aa, Homo sapiens
  SITE (1)..(9): One or more of the listed amino acids can be phosphorylated as set forth in the Tables
ATYTPQAPK

SEQ ID NO: 197 - protein, 11 aa, Homo sapiens
  SITE (1)..(11): One or more of the listed amino acids can be phosphorylated as set forth in the Tables
GTIRSRSFIFK

SEQ ID NO: 198 - protein, 10 aa, Homo sapiens
  SITE (1)..(10): One or more of the listed amino acids can be phosphorylated as set forth in the Tables
KLPDSPALAK

SEQ ID NO: 199 - protein, 11 aa, Homo sapiens
  SITE (1)..(11): One or more of the listed amino acids can be phosphorylated as set forth in the Tables
KLPDSPALAKK

SEQ ID NO: 200 - protein, 10 aa, Homo sapiens
  SITE (1)..(10): One or more of the listed amino acids can be phosphorylated as set forth in the Tables
KMPTTPVKAK

SEQ ID NO: 201 - protein, 10 aa, Homo sapiens
  SITE (1)..(10): One or more of the listed amino acids can be phosphorylated as set forth in the Tables
KTPTSPLKMK

SEQ ID NO: 202 - protein, 11 aa, Homo sapiens
  SITE (1)..(10): One or more of the listed amino acids can be phosphorylated as set forth in the Tables
KVKSSPLIEKL

SEQ ID NO: 203 - protein, 9 aa, Homo sapiens
  SITE (1)..(9): One or more of the listed amino acids can be phosphorylated as set forth in the Tables
KVLTPIKEK

SEQ ID NO: 204 - protein, 9 aa, Homo sapiens
  SITE (1)..(9): One or more of the listed amino acids can be phosphorylated as set forth in the Tables
RAKSPISLK

SEQ ID NO: 205 - protein, 9 aa, Homo sapiens
  SITE (1)..(10): One or more of the listed amino acids can be phosphorylated as set forth in the Tables
RILSGVVTK

SEQ ID NO: 206 - protein, 9 aa, Homo sapiens
  SITE (1)..(9): One or more of the listed amino acids can be phosphorylated as set forth in the Tables
RIYQYIQSR

SEQ ID NO: 207 - protein, 10 aa, Homo sapiens
  SITE (1)..(10): One or more of the listed amino acids can be phosphorylated as set forth in the Tables
RIYQYIQSRF

SEQ ID NO: 208 - protein, 11 aa, Homo sapiens
  SITE (1)..(11): One or more of the listed amino acids can be phosphorylated as set forth in the Tables
RIYQYIQSRFY

SEQ ID NO: 209 - protein, 12 aa, Homo sapiens
  SITE (1)..(12): One or more of the listed amino acids can be phosphorylated as set forth in the Tables
RLLDRSPSRSAK

SEQ ID NO: 210 - protein, 9 aa, Homo sapiens
  SITE (1)..(9): One or more of the listed amino acids can be phosphorylated as set forth in the Tables
RLPSSTLKR

SEQ ID NO: 211 - protein, 9 aa, Homo sapiens
  SITE (1)..(9): One or more of the listed amino acids can be phosphorylated as set forth in the Tables
RLSSPISKR

SEQ ID NO: 212 - protein, 9 aa, Homo sapiens
  SITE (1)..(9): One or more of the listed amino acids can be phosphorylated as set forth in the Tables
RQASPLVHR

SEQ ID NO: 213 - protein, 9 aa, Homo sapiens
  SITE (1)..(9): One or more of the listed amino acids can be phosphorylated as set forth in the Tables
RSVSLSMRK

SEQ ID NO: 214 - protein, 9 aa, Homo sapiens
  SITE (1)..(9): One or more of the listed amino acids can be phosphorylated as set forth in the Tables
RSYSRSFSR

SEQ ID NO: 215 - protein, 9 aa, Homo sapiens
  SITE (1)..(9): One or more of the listed amino acids can be phosphorylated as set forth in the Tables
RTASFAVRK

SEQ ID NO: 216 - protein, 10 aa, Homo sapiens
  SITE (1)..(10): One or more of the listed amino acids can be phosphorylated as set forth in the Tables
RTASPPPPPK

SEQ ID NO: 217 - protein, 11 aa, Homo sapiens
  SITE (1)..(11): One or more of the listed amino acids can be phosphorylated as set forth in the Tables
RTRSLSSLREK

SEQ ID NO: 218 - protein, 10 aa, Homo sapiens
  SITE (1)..(10): One or more of the listed amino acids can be phosphorylated as set forth in the Tables
RVRQSPLATR

SEQ ID NO: 219 - protein, 9 aa, Homo sapiens
  SITE (1)..(9): One or more of the listed amino acids can be phosphorylated as set forth in the Tables
RVSSRFSSR

SEQ ID NO: 220 - protein, 10 aa, Homo sapiens
  SITE (1)..(10): One or more of the listed amino acids can be phosphorylated as set forth in the Tables
RVSSVKLISK

SEQ ID NO: 221 - protein, 9 aa, Homo sapiens
  SITE (1)..(9): One or more of the listed amino acids can be phosphorylated as set forth in the Tables
RVYSPYNHR

SEQ ID NO: 222 - protein, 9 aa, Homo sapiens
  SITE (1)..(9): One or more of the listed amino acids can be phosphorylated as set forth in the Tables
SVRRSVLMK

SEQ ID NO: 223 - protein, 10 aa, Homo sapiens
  SITE (1)..(10): One or more of the listed amino acids can be phosphorylated as set forth in the Tables
GPRPGSPSAL

SEQ ID NO: 224 - protein, 10 aa, Homo sapiens
  SITE (1)..(10): One or more of the listed amino acids can be phosphorylated as set forth in the Tables
HPRSPNVLSV

SEQ ID NO: 225 - protein, 9 aa, Homo sapiens
  SITE (1)..(9): One or more of the listed amino acids can be phosphorylated as set forth in the Tables
KPRSPPRAL

SEQ ID NO: 226 - protein, 11 aa, Homo sapiens
  SITE (1)..(11): One or more of the listed amino acids can be phosphorylated as set forth in the Tables
KPRSPPRALVL

SEQ ID NO: 227 - protein, 12 aa, Homo sapiens
  SITE (1)..(12): One or more of the listed amino acids can be phosphorylated as set forth in the Tables
KPRSPPRALVLP

SEQ ID NO: 228 - protein, 9 aa, Homo sapiens
  SITE (1)..(9): One or more of the listed amino acids can be phosphorylated as set forth in the Tables
KPRSPVVEL

SEQ ID NO: 229 - protein, 8 aa, Homo sapiens
  SITE (1)..(8): One or more of the listed amino acids can be phosphorylated as set forth in the Tables
LPASPHQL

SEQ ID NO: 230 - protein, 9 aa, Homo sapiens
  SITE (1)..(9): One or more of the listed amino acids can be phosphorylated as set forth in the Tables
LPIFSRLSI

SEQ ID NO: 231 - protein, 10 aa, Homo sapiens
  SITE (1)..(10): One or more of the listed amino acids can be phosphorylated as set forth in the Tables
LPKSPPYTAF

SEQ ID NO: 232 - protein, 10 aa, Homo sapiens
  SITE (1)..(10): One or more of the listed amino acids can be phosphorylated as set forth in the Tables
MPRQPSATRL

SEQ ID NO: 233 - protein, 9 aa, Homo sapiens
  SITE (1)..(9): One or more of the listed amino acids can be phosphorylated as set forth in the Tables
RPASAGAML

SEQ ID NO: 234 - protein, 9 aa, Homo sapiens
  SITE (1)..(9): One or more of the listed amino acids can be phosphorylated as set forth in the Tables
RPKSNIVLL

SEQ ID NO: 235 - protein, 10 aa, Homo sapiens
  SITE (1)..(10): One or more of the listed amino acids can be phosphorylated as set forth in the Tables
RPNSPSPTAL

SEQ ID NO: 236 - protein, 10 aa, Homo sapiens
  SITE (1)..(10): One or more of the listed amino acids can be phosphorylated as set forth in the Tables
RPRSISVEEF

SEQ ID NO: 237 - protein, 10 aa, Homo sapiens
  SITE (1)..(10): One or more of the listed amino acids can be phosphorylated as set forth in the Tables
RPRSPPPRAP

SEQ ID NO: 238 - protein, 10 aa, Homo sapiens
  SITE (1)..(10): One or more of the listed amino acids can be phosphorylated as set forth in the Tables
RPRSPRQNSI

SEQ ID NO: 239 - protein, 10 aa, Homo sapiens
  SITE (1)..(10): One or more of the listed amino acids can be phosphorylated as set forth in the Tables
RPRPVSPSSL

SEQ ID NO: 240 - protein, 10 aa, Homo sapiens
  SITE (1)..(10): One or more of the listed amino acids can be phosphorylated as set forth in the Tables
RPYSPPFFSL

SEQ ID NO: 241 - protein, 9 aa, Homo sapiens
  SITE (1)..(9): One or more of the listed amino acids can be phosphorylated as set forth in the Tables
SPGSPRPAL

SEQ ID NO: 242 - protein, 10 aa, Homo sapiens
  SITE (1)..(10): One or more of the listed amino acids can be phosphorylated as set forth in the Tables
SPRRSRSISL

SEQ ID NO: 243 - protein, 10 aa, Homo sapiens
  SITE (1)..(10): One or more of the listed amino acids can be phosphorylated as set forth in the Tables
SPRSPSTTYL

SEQ ID NO: 244 - protein, 10 aa, Homo sapiens
  SITE (1)..(10): One or more of the listed amino acids can be phosphorylated as set forth in the Tables
VPREVLRLSL

SEQ ID NO: 245 - protein, 8 aa, Homo sapiens
  SITE (1)..(8): One or more of the listed amino acids can be phosphorylated as set forth in the Tables
ITQGTLKY

SEQ ID NO: 246 - protein, 8 aa, Homo sapiens
  SITE (1)..(8): One or more of the listed amino acids can be phosphorylated as set forth in the Tables
NTDSPLRY

SEQ ID NO: 247 - protein, 10 aa, Homo sapiens
  SITE (1)..(10): One or more of the listed amino acids can be phosphorylated as set forth in the Tables
QLDSPQRALY

SEQ ID NO: 248 - protein, 10 aa, Homo sapiens
  SITE (1)..(10): One or more of the listed amino acids can be phosphorylated as set forth in the Tables
RQASIELPSM

SEQ ID NO: 249 - protein, 10 aa, Homo sapiens
  SITE (1)..(10): One or more of the listed amino acids can be phosphorylated as set forth in the Tables
HRLSPVKGEF

SEQ ID NO: 250 - protein, 9 aa, Homo sapiens
  SITE (1)..(9): One or more of the listed amino acids can be phosphorylated as set forth in the Tables
KRFSFKKSF

SEQ ID NO: 251 - protein, 9 aa, Homo sapiens
  SITE (1)..(9): One or more of the listed amino acids can be phosphorylated as set forth in the Tables
KRLSPAPQL

SEQ ID NO: 252 - protein, 8 aa, Homo sapiens
  SITE (1)..(8): One or more of the listed amino acids can be phosphorylated as set forth in the Tables
KRMSPKEL

SEQ ID NO: 253 - protein, 10 aa, Homo sapiens
  SITE (1)..(10): One or more of the listed amino acids can be phosphorylated as set forth in the Tables
RRASLSEIGF

SEQ ID NO: 254 - protein, 9 aa, Homo sapiens
  SITE (1)..(9): One or more of the listed amino acids can be phosphorylated as set forth in the Tables
RRDSIVAEL

SEQ ID NO: 255 - protein, 10 aa, Homo sapiens
  SITE (1)..(10): One or more of the listed amino acids can be phosphorylated as set forth in the Tables
RRFTPPSPAF

SEQ ID NO: 256 - protein, 9 aa, Homo sapiens
  SITE (1)..(9): One or more of the listed amino acids can be phosphorylated as set forth in the Tables
RRFSRSPIR

SEQ ID NO: 257 - protein, 9 aa, Homo sapiens
  SITE (1)..(9): One or more of the listed amino acids can be phosphorylated as set forth in the Tables
RRFSRSPIR

SEQ ID NO: 258 - protein, 10 aa, Homo sapiens
  SITE (1)..(10): One or more of the listed amino acids can be phosphorylated as set forth in the Tables
RRFSRSPIRR

SEQ ID NO: 259 - protein, 10 aa, Homo sapiens
  SITE (1)..(10): One or more of the listed amino acids can be phosphorylated as set forth in the Tables
RRIDISPSTF

SEQ ID NO: 260 - protein, 10 aa, Homo sapiens
  SITE (1)..(10): One or more of the listed amino acids can be phosphorylated as set forth in the Tables
RRISGVDRYY

SEQ ID NO: 261 - protein, 9 aa, Homo sapiens
  SITE (1)..(9): One or more of the listed amino acids can be phosphorylated as set forth in the Tables
RRLSNLPTV

SEQ ID NO: 262 - protein, 9 aa, Homo sapiens
  SITE (1)..(9): One or more of the listed amino acids can be phosphorylated as set forth in the Tables
RRMSLLSVV

SEQ ID NO: 263 - protein, 9 aa, Homo sapiens
  SITE (1)..(9): One or more of the listed amino acids can be phosphorylated as set forth in the Tables
RRYSPPIQR

SEQ ID NO: 264 - protein, 9 aa, Homo sapiens
  SITE (1)..(9): One or more of the listed amino acids can be phosphorylated as set forth in the Tables
SRWSGSHQF

SEQ ID NO: 265 - protein, 11 aa, Homo sapiens
  SITE (1)..(11): One or more of the listed amino acids can be phosphorylated as set forth in the Tables
TRLSPAKIVLR

SEQ ID NO: 266 - protein, 11 aa, Homo sapiens
  SITE (1)..(11): One or more of the listed amino acids can be phosphorylated as set forth in the Tables
APRKGSFSALM

SEQ ID NO: 267 - protein, 9 aa, Homo sapiens
  SITE (1)..(9): One or more of the listed amino acids can be phosphorylated as set forth in the Tables
APRRYSSSL

SEQ ID NO: 268 - protein, 10 aa, Homo sapiens
  SITE (1)..(10): One or more of the listed amino acids can be phosphorylated as set forth in the Tables
APRSPPPSRP

SEQ ID NO: 269 - protein, 9 aa, Homo sapiens
  SITE (1)..(9): One or more of the listed amino acids can be phosphorylated as set forth in the Tables
EPKRRSARL

SEQ ID NO: 270 - protein, 9 aa, Homo sapiens
  SITE (1)..(9): One or more of the listed amino acids can be phosphorylated as set forth in the Tables
EPRSPSHSM

SEQ ID NO: 271 - protein, 9 aa, Homo sapiens
  SITE (1)..(9): One or more of the listed amino acids can be phosphorylated as set forth in the Tables
FPHSLLSVI

SEQ ID NO: 272 - protein, 10 aa, Homo sapiens
  SITE (1)..(10): One or more of the listed amino acids can be phosphorylated as set forth in the Tables
FRRSPTKSSL

SEQ ID NO: 273 - protein, 12 aa, Homo sapiens
  SITE (1)..(12): One or more of the listed amino acids can be phosphorylated as set forth in the Tables
FRRSPTKSSLDY

SEQ ID NO: 274 - protein, 8 aa, Homo sapiens
  SITE (1)..(8): One or more of the listed amino acids can be phosphorylated as set forth in the Tables
FSISPVRL

SEQ ID NO: 275 - protein, 9 aa, Homo sapiens
  SITE (1)..(9): One or more of the listed amino acids can be phosphorylated as set forth in the Tables
GAQPGRHSV

SEQ ID NO: 276 - protein, 10 aa, Homo sapiens
  SITE (1)..(10): One or more of the listed amino acids can be phosphorylated as set forth in the Tables
GPRSASLLSL

SEQ ID NO: 277 - protein, 10 aa, Homo sapiens
  SITE (1)..(10): One or more of the listed amino acids can be phosphorylated as set forth in the Tables
GPRSASLLSL

SEQ ID NO: 278 - protein, 10 aa, Homo sapiens
  SITE (1)..(10): One or more of the listed amino acids can be phosphorylated as set forth in the Tables
GPRSASLLSL

SEQ ID NO: 279 - protein, 9 aa, Homo sapiens
  SITE (1)..(9): One or more of the listed amino acids can be phosphorylated as set forth in the Tables
HPRSPTPTL

SEQ ID NO: 280 - protein, 9 aa, Homo sapiens
  SITE (1)..(9): One or more of the listed amino acids can be phosphorylated as set forth in the Tables
HPRSPTPTL

SEQ ID NO: 281 - protein, 9 aa, Homo sapiens
  SITE (1)..(9): One or more of the listed amino acids can be phosphorylated as set forth in the Tables
KARSPGRAL

SEQ ID NO: 282 - protein, 9 aa, Homo sapiens
  SITE (1)..(9): One or more of the listed amino acids can be phosphorylated as set forth in the Tables
KPASPARRL

SEQ ID NO: 283 - protein, 11 aa, Homo sapiens
  SITE (1)..(11): One or more of the listed amino acids can be phosphorylated as set forth in the Tables
KPASPKFIVTL

SEQ ID NO: 284 - protein, 9 aa, Homo sapiens
  SITE (1)..(9): One or more of the listed amino acids can be phosphorylated as set forth in the Tables
KPPHSPLVL

SEQ ID NO: 285 - protein, 10 aa, Homo sapiens
  SITE (1)..(10): One or more of the listed amino acids can be phosphorylated as set forth in the Tables
KPPSPEHQSL

SEQ ID NO: 286 - protein, 10 aa, Homo sapiens
  SITE (1)..(10): One or more of the listed amino acids can be phosphorylated as set forth in the Tables
KPPSPSPIEM

SEQ ID NO: 287 - protein, 9 aa, Homo sapiens
  SITE (1)..(9): One or more of the listed amino acids can be phosphorylated as set forth in the Tables
KPPTPGASF

SEQ ID NO: 288 - protein, 9 aa, Homo sapiens
  SITE (1)..(9): One or more of the listed amino acids can be phosphorylated as set forth in the Tables
KPPYRSHSL

SEQ ID NO: 289 - protein, 9 aa, Homo sapiens
  SITE (1)..(9): One or more of the listed amino acids can be phosphorylated as set forth in the Tables
KPQTRGKTF

SEQ ID NO: 290 - protein, 9 aa, Homo sapiens
  SITE (1)..(9): One or more of the listed amino acids can be phosphorylated as set forth in the Tables
KPRPPPLSP

SEQ ID NO: 291 - protein, 9 aa, Homo sapiens
  SITE (1)..(9): One or more of the listed amino acids can be phosphorylated as set forth in the Tables
KPRSPDHVL

SEQ ID NO: 292 - protein, 9 aa, Homo sapiens
  SITE (1)..(9): One or more of the listed amino acids can be phosphorylated as set forth in the Tables
KPRSPPRAL

SEQ ID NO: 293 - protein, 10 aa, Homo sapiens
  SITE (1)..(10): One or more of the listed amino acids can be phosphorylated as set forth in the Tables
KPRSPPRALV

SEQ ID NO: 294 - protein, 11 aa, Homo sapiens
  SITE (1)..(11): One or more of the listed amino acids can be phosphorylated as set forth in the Tables
KPRSPPRALVL

SEQ ID NO: 295 - protein, 9 aa, Homo sapiens
  SITE (1)..(9): One or more of the listed amino acids can be phosphorylated as set forth in the Tables
KPRSPVVEL

SEQ ID NO: 296 - protein, 9 aa, Homo sapiens
  SITE (1)..(9): One or more of the listed amino acids can be phosphorylated as set forth in the Tables
KPYSPLASL

SEQ ID NO: 297 - protein, 9 aa, Homo sapiens
  SITE (1)..(9): One or more of the listed amino acids can be phosphorylated as set forth in the Tables
LPASPRARL

SEQ ID NO: 298 - protein, 9 aa, Homo sapiens
  SITE (1)..(9): One or more of the listed amino acids can be phosphorylated as set forth in the Tables
LPIFSRLSI

SEQ ID NO: 299 - protein, 10 aa, Homo sapiens
  SITE (1)..(10): One or more of the listed amino acids can be phosphorylated as set forth in the Tables
LPKSPPYTAF

SEQ ID NO: 300 - protein, 10 aa, Homo sapiens
  SITE (1)..(10): One or more of the listed amino acids can be phosphorylated as set forth in the Tables
LPRGSSPSVL

SEQ ID NO: 301 - protein, 10 aa, Homo sapiens
  SITE (1)..(10): One or more of the listed amino acids can be phosphorylated as set forth in the Tables
MPRQPSATRL

SEQ ID NO: 302 - protein, 11 aa, Homo sapiens
  SITE (1)..(11): One or more of the listed amino acids can be phosphorylated as set forth in the Tables
QPRSPGPDYSL

SEQ ID NO: 303 - protein, 10 aa, Homo sapiens
  SITE (1)..(10): One or more of the listed amino acids can be phosphorylated as set forth in the Tables
QPRTPSPLVL

SEQ ID NO: 304 - protein, 10 aa, Homo sapiens
  SITE (1)..(10): One or more of the listed amino acids can be phosphorylated as set forth in the Tables
QPRTPSPLVL

SEQ ID NO: 305 - protein, 9 aa, Homo sapiens
  SITE (1)..(9): One or more of the listed amino acids can be phosphorylated as set forth in the Tables
RAPSPSSRM

SEQ ID NO: 306 - protein, 9 aa, Homo sapiens
  SITE (1)..(9): One or more of the listed amino acids can be phosphorylated as set forth in the Tables
RPAKSMDSL

SEQ ID NO: 307 - protein, 9 aa, Homo sapiens
  SITE (1)..(9): One or more of the listed amino acids can be phosphorylated as set forth in the Tables
RPASAGAML

SEQ ID NO: 308 - protein, 11 aa, Homo sapiens
  SITE (1)..(11): One or more of the listed amino acids can be phosphorylated as set forth in the Tables
RPASARAQPGL

SEQ ID NO: 309 - protein, 9 aa, Homo sapiens
  SITE (1)..(9): One or more of the listed amino acids can be phosphorylated as set forth in the Tables
RPASPAAKL

SEQ ID NO: 310 - protein, 10 aa, Homo sapiens
  SITE (1)..(10): One or more of the listed amino acids can be phosphorylated as set forth in the Tables
RPATGGPGVA

SEQ ID NO: 311 - protein, 9 aa, Homo sapiens
  SITE (1)..(9): One or more of the listed amino acids can be phosphorylated as set forth in the Tables
RPATPTSQF

SEQ ID NO: 312 - protein, 11 aa, Homo sapiens
  SITE (1)..(11): One or more of the listed amino acids can be phosphorylated as set forth in the Tables
RPDSRLGKTEL

SEQ ID NO: 313 - protein, 9 aa, Homo sapiens
  SITE (1)..(9): One or more of the listed amino acids can be phosphorylated as set forth in the Tables
RPFSPREAL

SEQ ID NO: 314 - protein, 9 aa, Homo sapiens
  SITE (1)..(9): One or more of the listed amino acids can be phosphorylated as set forth in the Tables
RPHSPEKAF

SEQ ID NO: 315 - protein, 10 aa, Homo sapiens
  SITE (1)..(10): One or more of the listed amino acids can be phosphorylated as set forth in the Tables
RPITPPRNSA

SEQ ID NO: 316 - protein, 9 aa, Homo sapiens
  SITE (1)..(9): One or more of the listed amino acids can be phosphorylated as set forth in the Tables
RPISPGLSY

SEQ ID NO: 317 - protein, 9 aa, Homo sapiens
  SITE (1)..(9): One or more of the listed amino acids can be phosphorylated as set forth in the Tables
RPKLSSPAL

SEQ ID NO: 318 - protein, 9 aa, Homo sapiens
  SITE (1)..(9): One or more of the listed amino acids can be phosphorylated as set forth in the Tables
RPKPSSSPV

SEQ ID NO: 319 - protein, 10 aa, Homo sapiens
  SITE (1)..(10): One or more of the listed amino acids can be phosphorylated as set forth in the Tables
RPNSPSPTAL

SEQ ID NO: 320 - protein, 10 aa, Homo sapiens
  SITE (1)..(10): One or more of the listed amino acids can be phosphorylated as set forth in the Tables
RPPPPPDTPP

SEQ ID NO: 321 - protein, 9 aa, Homo sapiens
  SITE (1)..(9): One or more of the listed amino acids can be phosphorylated as set forth in the Tables
RPPSPGPVL

SEQ ID NO: 322 - protein, 10 aa, Homo sapiens
  SITE (1)..(10): One or more of the listed amino acids can be phosphorylated as set forth in the Tables
RPPSSEFLDL

SEQ ID NO: 323 - protein, 10 aa, Homo sapiens
  SITE (1)..(10): One or more of the listed amino acids can be phosphorylated as set forth in the Tables
RPQRATSNVF

SEQ ID NO: 324 - protein, 10 aa, Homo sapiens
  SITE (1)..(10): One or more of the listed amino acids can be phosphorylated as set forth in the Tables
RPQRATSNVF

SEQ ID NO: 325 - protein, 11 aa, Homo sapiens
  SITE (1)..(11): One or more of the listed amino acids can be phosphorylated as set forth in the Tables
RPRANSGGVDL

SEQ ID NO: 326 - protein, 9 aa, Homo sapiens
  SITE (1)..(9): One or more of the listed amino acids can be phosphorylated as set forth in the Tables
RPRGSQSLL

SEQ ID NO: 327 - protein, 10 aa, Homo sapiens
  SITE (1)..(10): One or more of the listed amino acids can be phosphorylated as set forth in the Tables
RPRPHSAPSL

SEQ ID NO: 328 - protein, 10 aa, Homo sapiens
  SITE (1)..(10): One or more of the listed amino acids can be phosphorylated as set forth in the Tables
RPRPVSPSSL

SEQ ID NO: 329 - protein, 9 aa, Homo sapiens
  SITE (1)..(9): One or more of the listed amino acids can be phosphorylated as set forth in the Tables
RPRRSSTQL

SEQ ID NO: 330 - protein, 8 aa, Homo sapiens
  SITE (1)..(8): One or more of the listed amino acids can be phosphorylated as set forth in the Tables
RPRSAVLL

SEQ ID NO: 331 - protein, 9 aa, Homo sapiens
  SITE (1)..(9): One or more of the listed amino acids can be phosphorylated as set forth in the Tables
RPRSLEVTI

SEQ ID NO: 332 - protein, 12 aa, Homo sapiens
  SITE (1)..(12): One or more of the listed amino acids can be phosphorylated as set forth in the Tables
RPRSLSSPTVTL

SEQ ID NO: 333 - protein, 9 aa, Homo sapiens
  SITE (1)..(9): One or more of the listed amino acids can be phosphorylated as set forth in the Tables
RPRSPAARL

SEQ ID NO: 334 - protein, 11 aa, Homo sapiens
  SITE (1)..(11): One or more of the listed amino acids can be phosphorylated as set forth in the Tables
RPRSPGSNSKV

SEQ ID NO: 335 - protein, 10 aa, Homo sapiens
  SITE (1)..(10): One or more of the listed amino acids can be phosphorylated as set forth in the Tables
RPRSPPPRAP

SEQ ID NO: 336 - protein, 10 aa, Homo sapiens
  SITE (1)..(10): One or more of the listed amino acids can be phosphorylated as set forth in the Tables
RPRSPRQNSI

SEQ ID NO: 337 - protein, 9 aa, Homo sapiens
  SITE (1)..(9): One or more of the listed amino acids can be phosphorylated as set forth in the Tables
RPRSPSPIS

SEQ ID NO: 338 - protein, 8 aa, Homo sapiens
  SITE (1)..(8): One or more of the listed amino acids can be phosphorylated as set forth in the Tables
RPRSPTGP

SEQ ID NO: 339 - protein, 12 aa, Homo sapiens
  SITE (1)..(12): One or more of the listed amino acids can be phosphorylated as set forth in the Tables
RPRSPTGPSNSF

SEQ ID NO: 340 - protein, 10 aa, Homo sapiens
  SITE (1)..(10): One or more of the listed amino acids can be phosphorylated as set forth in the Tables
RPRPVSPSSL

SEQ ID NO: 341 - protein, 9 aa, Homo sapiens
  SITE (1)..(9): One or more of the listed amino acids can be phosphorylated as set forth in the Tables
RPSGRRESL

SEQ ID NO: 342 - protein, 9 aa, Homo sapiens
  SITE (1)..(9): One or more of the listed amino acids can be phosphorylated as set forth in the Tables
RPSRSSPGL

SEQ ID NO: 343 - protein, 8 aa, Homo sapiens
  SITE (1)..(8): One or more of the listed amino acids can be phosphorylated as set forth in the Tables
RPSSLPDL

SEQ ID NO: 344 - protein, 9 aa, Homo sapiens
  SITE (1)..(9): One or more of the listed amino acids can be phosphorylated as set forth in the Tables
RPSSPALYF

SEQ ID NO: 345 - protein, 11 aa, Homo sapiens
  SITE (1)..(11): One or more of the listed amino acids can be phosphorylated as set forth in the Tables
RPSTPKSDSEL

SEQ ID NO: 346 - protein, 9 aa, Homo sapiens
  SITE (1)..(9): One or more of the listed amino acids can be phosphorylated as set forth in the Tables
RPTSRLNRL

SEQ ID NO: 347 - protein, 9 aa, Homo sapiens
  SITE (1)..(9): One or more of the listed amino acids can be phosphorylated as set forth in the Tables
RPVSPFQEL

SEQ ID NO: 348 - protein, 9 aa, Homo sapiens
  SITE (1)..(9): One or more of the listed amino acids can be phosphorylated as set forth in the Tables
RPVSPGKDI

SEQ ID NO: 349 - protein, 9 aa, Homo sapiens
  SITE (1)..(9): One or more of the listed amino acids can be phosphorylated as set forth in the Tables
RPVTPVSDL

SEQ ID NO: 350 - protein, 9 aa, Homo sapiens
  SITE (1)..(9): One or more of the listed amino acids can be phosphorylated as set forth in the Tables
RPWSPAVSA

SEQ ID NO: 351 - protein, 10 aa, Homo sapiens
  SITE (1)..(10): One or more of the listed amino acids can be phosphorylated as set forth in the Tables
RPYSPPFFSL

SEQ ID NO: 352 - protein, 9 aa, Homo sapiens
  SITE (1)..(9): One or more of the listed amino acids can be phosphorylated as set forth in the Tables
RRKSQVAEL

SEQ ID NO: 353 - protein, 10 aa, Homo sapiens
  SITE (1)..(10): One or more of the listed amino acids can be phosphorylated as set forth in the Tables
RRLSGPLHTL

SEQ ID NO: 354 - protein, 9 aa, Homo sapiens
  SITE (1)..(9): One or more of the listed amino acids can be phosphorylated as set forth in the Tables
RRPSYTLGM

SEQ ID NO: 355 - protein, 9 aa, Homo sapiens
  SITE (1)..(9): One or more of the listed amino acids can be phosphorylated as set forth in the Tables
RRSSFLQVF

SEQ ID NO: 356 - protein, 12 aa, Homo sapiens
  SITE (1)..(12): One or more of the listed amino acids can be phosphorylated as set forth in the Tables
RRSSLDAEIDSL

SEQ ID NO: 357 - protein, 9 aa, Homo sapiens
  SITE (1)..(9): One or more of the listed amino acids can be phosphorylated as set forth in the Tables
RRSSQSWSL

SEQ ID NO: 358 - protein, 9 aa, Homo sapiens
  SITE (1)..(9): One or more of the listed amino acids can be phosphorylated as set forth in the Tables
RSESKDRKL

SEQ ID NO: 359 - protein, 9 aa, Homo sapiens
  SITE (1)..(9): One or more of the listed amino acids can be phosphorylated as set forth in the Tables
RSGSLERKV

SEQ ID NO: 360 - protein, 9 aa, Homo sapiens
  SITE (1)..(9): One or more of the listed amino acids can be phosphorylated as set forth in the Tables
RSLSPGGAA

SEQ ID NO: 361 - protein, 8 aa, Homo sapiens
  SITE (1)..(8): One or more of the listed amino acids can be phosphorylated as set forth in the Tables
RSLSPLLF

SEQ ID NO: 362 - protein, 9 aa, Homo sapiens
  SITE (1)..(9): One or more of the listed amino acids can be phosphorylated as set forth in the Tables
RSRSPRPAL

SEQ ID NO: 363 - protein, 10 aa, Homo sapiens
  SITE (1)..(10): One or more of the listed amino acids can be phosphorylated as set forth in the Tables
RTESDSGLKK

SEQ ID NO: 364 - protein, 9 aa, Homo sapiens
  SITE (1)..(9): One or more of the listed amino acids can be phosphorylated as set forth in the Tables
RTFSPTYGL

SEQ ID NO: 365 - protein, 9 aa, Homo sapiens
  SITE (1)..(9): One or more of the listed amino acids can be phosphorylated as set forth in the Tables
RTRSPSPTL

SEQ ID NO: 366 - protein, 9 aa, Homo sapiens
  SITE (1)..(9): One or more of the listed amino acids can be phosphorylated as set forth in the Tables
RVRSPTRSP

SEQ ID NO: 367 - protein, 9 aa, Homo sapiens
  SITE (1)..(9): One or more of the listed amino acids can be phosphorylated as set forth in the Tables
SPASPKISL

SEQ ID NO: 368 - protein, 11 aa, Homo sapiens
  SITE (1)..(11): One or more of the listed amino acids can be phosphorylated as set forth in the Tables
SPEKAGRRSSL

SEQ ID NO: 369 - protein, 9 aa, Homo sapiens
  SITE (1)..(9): One or more of the listed amino acids can be phosphorylated as set forth in the Tables
SPFKRQLSL

SEQ ID NO: 370 - protein, 10 aa, Homo sapiens
  SITE (1)..(10): One or more of the listed amino acids can be phosphorylated as set forth in the Tables
SPGLARKRSL

SEQ ID NO: 371 - protein, 9 aa, Homo sapiens
  SITE (1)..(9): One or more of the listed amino acids can be phosphorylated as set forth in the Tables
SPKSPGLKA

SEQ ID NO: 372 - protein, 9 aa, Homo sapiens
  SITE (1)..(9): One or more of the listed amino acids can be phosphorylated as set forth in the Tables
SPKSPTAAL

SEQ ID NO: 373 - protein, 9 aa, Homo sapiens
  SITE (1)..(9): One or more of the listed amino acids can be phosphorylated as set forth in the Tables
SPRERSPAL

SEQ ID NO: 374 - protein, 10 aa, Homo sapiens
  SITE (1)..(10): One or more of the listed amino acids can be phosphorylated as set forth in the Tables
SPRRSRSISL

SEQ ID NO: 375 - protein, 10 aa, Homo sapiens
  SITE (1)..(10): One or more of the listed amino acids can be phosphorylated as set forth in the Tables
SPRRSRSISL

SEQ ID NO: 376 - protein, 9 aa, Homo sapiens
  SITE (1)..(9): One or more of the listed amino acids can be phosphorylated as set forth in the Tables
SPRSITSTP

SEQ ID NO: 377 - protein, 9 aa, Homo sapiens
  SITE (1)..(9): One or more of the listed amino acids can be phosphorylated as set forth in the Tables
SPRSPGKPM

SEQ ID NO: 378 - protein, 9 aa, Homo sapiens
  SITE (1)..(9): One or more of the listed amino acids can be phosphorylated as set forth in the Tables
SPRSPGRSL

SEQ ID NO: 379 - protein, 10 aa, Homo sapiens
  SITE (1)..(10): One or more of the listed amino acids can be phosphorylated as set forth in the Tables
SPRSPSTTYL

SEQ ID NO: 380 - protein, 11 aa, Homo sapiens
  SITE (1)..(11): One or more of the listed amino acids can be phosphorylated as set forth in the Tables
SPRTPVSPVKF

SEQ ID NO: 381 - protein, 11 aa, Homo sapiens
  SITE (1)..(11): One or more of the listed amino acids can be phosphorylated as set forth in the Tables
SPRTPVSPVKF

SEQ ID NO: 382 - protein, 11 aa, Homo sapiens
  SITE (1)..(11): One or more of the listed amino acids can be phosphorylated as set forth in the Tables
SPSSPSVRRQL

SEQ ID NO: 383 - protein, 13 aa, Homo sapiens
  SITE (1)..(13): One or more of the listed amino acids can be phosphorylated as set forth in the Tables
SPSTSRSGGSSRL

SEQ ID NO: 384 - protein, 8 aa, Homo sapiens
  SITE (1)..(8): One or more of the listed amino acids can be phosphorylated as set forth in the Tables
SPVVHQSL

SEQ ID NO: 385 - protein, 10 aa, Homo sapiens
  SITE (1)..(10): One or more of the listed amino acids can be phosphorylated as set forth in the Tables
TPAQPQRRSL

SEQ ID NO: 386 - protein, 11 aa, Homo sapiens
  SITE (1)..(11): One or more of the listed amino acids can be phosphorylated as set forth in the Tables
TPISPGRASGM

SEQ ID NO: 387 - protein, 9 aa, Homo sapiens
  SITE (1)..(9): One or more of the listed amino acids can be phosphorylated as set forth in the Tables
TPRSPPLGL

SEQ ID NO: 388 - protein, 10 aa, Homo sapiens
  SITE (1)..(10): One or more of the listed amino acids can be phosphorylated as set forth in the Tables
TPRSPPLGLI

SEQ ID NO: 389 - protein, 13 aa, Homo sapiens
  SITE (1)..(13): One or more of the listed amino acids can be phosphorylated as set forth in the Tables
VPRSPKHAHSSSL

SEQ ID NO: 390 - protein, 8 aa, Homo sapiens
  SITE (1)..(8): One or more of the listed amino acids can be phosphorylated as set forth in the Tables
YPSSPRKL

SEQ ID NO: 391 - protein, 11 aa, Homo sapiens
  SITE (1)..(11): One or more of the listed amino acids can be phosphorylated as set forth in the Tables
YQRSFDEVEGV

SEQ ID NO: 392 - protein, 12 aa, Homo sapiens
  SITE (1)..(12): One or more of the listed amino acids can be phosphorylated as set forth in the Tables
YQRSFDEVEGVF

SEQ ID NO: 393 - protein, 10 aa, Homo sapiens
  SITE (1)..(10): One or more of the listed amino acids can be phosphorylated as set forth in the Tables
ALYSPAQPSL

SEQ ID NO: 394 - protein, 9 aa, Homo sapiens
  SITE (1)..(9): One or more of the listed amino acids can be phosphorylated as set forth in the Tables
AMAASPHAV

SEQ ID NO: 395 - protein, 11 aa, Homo sapiens
  SITE (1)..(11): One or more of the listed amino acids can be phosphorylated as set forth in the Tables
AVVSPPALHNA

SEQ ID NO: 396 - protein, 9 aa, Homo sapiens
  SITE (1)..(9): One or more of the listed amino acids can be phosphorylated as set forth in the Tables
GLLGSPVRA

SEQ ID NO: 397 - protein, 10 aa, Homo sapiens
  SITE (1)..(10): One or more of the listed amino acids can be phosphorylated as set forth in the Tables
ILKSPEIQRA

SEQ ID NO: 398 - protein, 9 aa, Homo sapiens
  SITE (1)..(9): One or more of the listed amino acids can be phosphorylated as set forth in the Tables
IMDRTPEKL

SEQ ID NO: 399 - protein, 10 aa, Homo sapiens
  SITE (1)..(10): One or more of the listed amino acids can be phosphorylated as set forth in the Tables
KLASPELERL

SEQ ID NO: 400 - protein, 10 aa, Homo sapiens
  SITE (1)..(10): One or more of the listed amino acids can be phosphorylated as set forth in the Tables
KLFPDTPLAL

SEQ ID NO: 401 - protein, 11 aa, Homo sapiens
  SITE (1)..(11): One or more of the listed amino acids can be phosphorylated as set forth in the Tables
KLIDIVSSQKV

SEQ ID NO: 402 - protein, 13 aa, Homo sapiens
  SITE (1)..(13): One or more of the listed amino acids can be phosphorylated as set forth in the Tables
KLLDFGSLSNLQV

SEQ ID NO: 403 - protein, 10 aa, Homo sapiens
  SITE (1)..(10): One or more of the listed amino acids can be phosphorylated as set forth in the Tables
KLLSPSNEKL

SEQ ID NO: 404 - protein, 10 aa, Homo sapiens
  SITE (1)..(10): One or more of the listed amino acids can be phosphorylated as set forth in the Tables
KLLSSAQRTL

SEQ ID NO: 405 - protein, 11 aa, Homo sapiens
  SITE (1)..(11): One or more of the listed amino acids can be phosphorylated as set forth in the Tables
KLMSPKADVKL

SEQ ID NO: 406 - protein, 9 aa, Homo sapiens
  SITE (1)..(9): One or more of the listed amino acids can be phosphorylated as set forth in the Tables
KVQVTSLSV

SEQ ID NO: 407 - protein, 9 aa, Homo sapiens
  SITE (1)..(9): One or more of the listed amino acids can be phosphorylated as set forth in the Tables
LMFSPVTSL

SEQ ID NO: 408 - protein, 9 aa, Homo sapiens
  SITE (1)..(9): One or more of the listed amino acids can be phosphorylated as set forth in the Tables
RLDSYVRSL

SEQ ID NO: 409 - protein, 9 aa, Homo sapiens
  SITE (1)..(9): One or more of the listed amino acids can be phosphorylated as set forth in the Tables
RLFSKELRC

SEQ ID NO: 410 - protein, 9 aa, Homo sapiens
  SITE (1)..(9): One or more of the listed amino acids can be phosphorylated as set forth in the Tables
RLLSPLSSA

SEQ ID NO: 411 - protein, 9 aa, Homo sapiens
  SITE (1)..(9): One or more of the listed amino acids can be phosphorylated as set forth in the Tables
RLQSTSERL

SEQ ID NO: 412 - protein, 9 aa, Homo sapiens
  SITE (1)..(9): One or more of the listed amino acids can be phosphorylated as set forth in the Tables
RLSSPLHFV

SEQ ID NO: 413 - protein, 11 aa, Homo sapiens
  SITE (1)..(11): One or more of the listed amino acids can be phosphorylated as set forth in the Tables
RQDSTPGKVFL

SEQ ID NO: 414 - protein, 9 aa, Homo sapiens
  SITE (1)..(9): One or more of the listed amino acids can be phosphorylated as set forth in the Tables
RQISQDVKL

SEQ ID NO: 415 - protein, 10 aa, Homo sapiens
  SITE (1)..(10): One or more of the listed amino acids can be phosphorylated as set forth in the Tables
RQLSSGVSEI

SEQ ID NO: 416 - protein, 9 aa, Homo sapiens
  SITE (1)..(9): One or more of the listed amino acids can be phosphorylated as set forth in the Tables
RTFSPTYGL

SEQ ID NO: 417 - protein, 9 aa, Homo sapiens
  SITE (1)..(9): One or more of the listed amino acids can be phosphorylated as set forth in the Tables
RTLSHISEA

SEQ ID NO: 418 - protein, 9 aa, Homo sapiens
  SITE (1)..(9): One or more of the listed amino acids can be phosphorylated as set forth in the Tables
RVASPTSGV

SEQ ID NO: 419 - protein, 9 aa, Homo sapiens
  SITE (1)..(9): One or more of the listed amino acids can be phosphorylated as set forth in the Tables
SLLTSPPKA

SEQ ID NO: 420 - protein, 9 aa, Homo sapiens
  SITE (1)..(9): One or more of the listed amino acids can be phosphorylated as set forth in the Tables
SLQPRSHSV

SEQ ID NO: 421 - protein, 9 aa, Homo sapiens
  SITE (1)..(9): One or more of the listed amino acids can be phosphorylated as set forth in the Tables
SMTRSPPRV

SEQ ID NO: 422 - protein, 11 aa, Homo sapiens
  SITE (1)..(11): One or more of the listed amino acids can be phosphorylated as set forth in the Tables
TLASPSVFKST

SEQ ID NO: 423 - protein, 10 aa, Homo sapiens
  SITE (1)..(10): One or more of the listed amino acids can be phosphorylated as set forth in the Tables
VLKGSRSSEL

SEQ ID NO: 424 - protein, 9 aa, Homo sapiens
  SITE (1)..(9): One or more of the listed amino acids can be phosphorylated as set forth in the Tables
VLLSPVPEL

SEQ ID NO: 425 - protein, 10 aa, Homo sapiens
  SITE (1)..(10): One or more of the listed amino acids can be phosphorylated as set forth in the Tables
VMFRTPLASV

SEQ ID NO: 426 - protein, 9 aa, Homo sapiens
  SITE (1)..(9): One or more of the listed amino acids can be phosphorylated as set forth in the Tables
VMIGSPKKV

SEQ ID NO: 427 - protein, 10 aa, Homo sapiens
  SITE (1)..(10): One or more of the listed amino acids can be phosphorylated as set forth in the Tables
YLDSGIHSGA

SEQ ID NO: 428 - protein, 11 aa, Homo sapiens
  SITE (1)..(11): One or more of the listed amino acids can be phosphorylated as set forth in the Tables
ALDSGASLLHL

SEQ ID NO: 429 - protein, 11 aa, Homo sapiens
  SITE (1)..(11): One or more of the listed amino acids can be phosphorylated as set forth in the Tables
ALGSRESLATI

SEQ ID NO: 430 - protein, 13 aa, Homo sapiens
  SITE (1)..(13): One or more of the listed amino acids can be phosphorylated as set forth in the Tables
AMLGSKSPDPYRL

SEQ ID NO: 431 - protein, 9 aa, Homo sapiens
  SITE (1)..(9): One or more of the listed amino acids can be phosphorylated as set forth in the Tables
AVIHQSLGL

SEQ ID NO: 432 - protein, 8 aa, Homo sapiens
  SITE (1)..(8): One or more of the listed amino acids can be phosphorylated as set forth in the Tables
DSSEEKFL

SEQ ID NO: 433 - protein, 12 aa, Homo sapiens
  SITE (1)..(12): One or more of the listed amino acids can be phosphorylated as set forth in the Tables
GGSFGGRSSGSP

SEQ ID NO: 434 - protein, 11 aa, Homo sapiens
  SITE (1)..(11): One or more of the listed amino acids can be phosphorylated as set forth in the Tables
GLLSPARLYAI

SEQ ID NO: 435 - protein, 9 aa, Homo sapiens
  SITE (1)..(9): One or more of the listed amino acids can be phosphorylated as set forth in the Tables
ILDSGIYRI

SEQ ID NO: 436 - protein, 9 aa, Homo sapiens
  SITE (1)..(9): One or more of the listed amino acids can be phosphorylated as set forth in the Tables
KAKSPAPGL

SEQ ID NO: 437 - protein, 10 aa, Homo sapiens
  SITE (1)..(10): One or more of the listed amino acids can be phosphorylated as set forth in the Tables
KIFSGVFVKV

SEQ ID NO: 438 - protein, 9 aa, Homo sapiens
  SITE (1)..(9): One or more of the listed amino acids can be phosphorylated as set forth in the Tables
KLDSPRVTV

SEQ ID NO: 439 - protein, 11 aa, Homo sapiens
  SITE (1)..(11): One or more of the listed amino acids can be phosphorylated as set forth in the Tables
KLFSPSKEAEL

SEQ ID NO: 440 - protein, 9 aa, Homo sapiens
  SITE (1)..(9): One or more of the listed amino acids can be phosphorylated as set forth in the Tables
KLIDRTESL

SEQ ID NO: 441 - protein, 9 aa, Homo sapiens
  SITE (1)..(9): One or more of the listed amino acids can be phosphorylated as set forth in the Tables
KLLQFYPSL

SEQ ID NO: 442 - protein, 9 aa, Homo sapiens
  SITE (1)..(9): One or more of the listed amino acids can be phosphorylated as set forth in the Tables
KLMAPDISL

SEQ ID NO: 443 - protein, 11 aa, Homo sapiens
  SITE (1)..(11): One or more of the listed amino acids can be phosphorylated as set forth in the Tables
KLMSPKADVKL

SEQ ID NO: 444 - protein, 10 aa, Homo sapiens
  SITE (1)..(10): One or more of the listed amino acids can be phosphorylated as set forth in the Tables
KMDSFLDMQL

SEQ ID NO: 445 - protein, 10 aa, Homo sapiens
  SITE (1)..(10): One or more of the listed amino acids can be phosphorylated as set forth in the Tables
KMYSEIDIKV

SEQ ID NO: 446 - protein, 9 aa, Homo sapiens
  SITE (1)..(9): One or more of the listed amino acids can be phosphorylated as set forth in the Tables
KVASLLHQV

SEQ ID NO: 447 - protein, 10 aa, Homo sapiens
  SITE (1)..(10): One or more of the listed amino acids can be phosphorylated as set forth in the Tables
KVLSTEEMEL

SEQ ID NO: 448 - protein, 11 aa, Homo sapiens
  SITE (1)..(11): One or more of the listed amino acids can be phosphorylated as set forth in the Tables
MLAESPSVPRL

SEQ ID NO: 449 - protein, 10 aa, Homo sapiens
  SITE (1)..(10): One or more of the listed amino acids can be phosphorylated as set forth in the Tables
RLASLNAEAL

SEQ ID NO: 450 - protein, 12 aa, Homo sapiens
  SITE (4)..(7): One or more of the listed serines can be phosphorylated
RPRSLSSPTVTL

SEQ ID NO: 451 - protein, 10 aa, Homo sapiens
  SITE (1)..(10): One or more of the listed amino acids can be phosphorylated as set forth in the Tables
RQASIELPSM

SEQ ID NO: 452 - protein, 12 aa, Homo sapiens
  SITE (1)..(12): One or more of the listed amino acids can be phosphorylated as set forth in the Tables
RQASIELPSMAV

SEQ ID NO: 453 - protein, 9 aa, Homo sapiens
  SITE (1)..(9): One or more of the listed amino acids can be phosphorylated as set forth in the Tables
RQASLSISV

SEQ ID NO: 454 - protein, 9 aa, Homo sapiens
  SITE (1)..(9): One or more of the listed amino acids can be phosphorylated as set forth in the Tables
RQISFKAEV

SEQ ID NO: 455 - protein, 9 aa, Homo sapiens
  SITE (1)..(9): One or more of the listed amino acids can be phosphorylated as set forth in the Tables
RQISQDVKL

SEQ ID NO: 456 - protein, 10 aa, Homo sapiens
  SITE (1)..(10): One or more of the listed amino acids can be phosphorylated as set forth in the Tables
RQLSSGVSEI

SEQ ID NO: 457 - protein, 9 aa, Homo sapiens
  SITE (1)..(9): One or more of the listed amino acids can be phosphorylated as set forth in the Tables
RTFSPTYGL

SEQ ID NO: 458 - protein, 10 aa, Homo sapiens
  SITE (1)..(10): One or more of the listed amino acids can be phosphorylated as set forth in the Tables
RTYSGPMNKV

SEQ ID NO: 459 - protein, 9 aa, Homo sapiens
  SITE (1)..(109: One or more of the listed amino acids can be phosphorylated as set forth in the Tables
RVASPTSGV

SEQ ID NO: 460 - protein, 9 aa, Homo sapiens
  SITE (1)..(9): One or more of the listed amino acids can be phosphorylated as set forth in the Tables
SMTRSPPRV

SEQ ID NO: 461 - protein, 9 aa, Homo sapiens
  SITE (1)..(9): One or more of the listed amino acids can be phosphorylated as set forth in the Tables
SMTRSPPRV

SEQ ID NO: 462 - protein, 9 aa, Homo sapiens
  SITE (1)..(9): One or more of the listed amino acids can be phosphorylated as set forth in the Tables
VLLSPVPEL

SEQ ID NO: 463 - protein, 10 aa, Homo sapiens
  SITE (5)..(7): One or more of the listed serines can be phosphorylated
VLMKSPSPAL

SEQ ID NO: 464 - protein, 9 aa, Homo sapiens
  SITE (1)..(9): One or more of the listed amino acids can be phosphorylated as set forth in the Tables
VMIGSPKKV

SEQ ID NO: 465 - protein, 11 aa, Homo sapiens
  SITE (1)..(11): One or more of the listed amino acids can be phosphorylated as set forth in the Tables
YQLSPTKLPSI

SEQ ID NO: 466 - protein, 21 aa, Homo sapiens
  SITE (1)..(21): One or more of the listed amino acids can be phosphorylated as set forth in the Tables
EPASPAASISRLSGEQVDGKG

SEQ ID NO: 467 - protein, 18 aa, Homo sapiens
  SITE (1)..(18): One or more of the listed amino acids can be phosphorylated as set forth in the Tables
SPAASISRLSGEQVDGKG

SEQ ID NO: 468 - protein, 15 aa, Homo sapiens
  SITE (1)..(15): One or more of the listed amino acids can be phosphorylated as set forth in the Tables
ASISRLSGEQVDGKG

SEQ ID NO: 469 - protein, 15 aa, Homo sapiens
  SITE (1)..(15): One or more of the listed amino acids can be phosphorylated as set forth in the Tables
ASISRLSGEQVDGKG

SEQ ID NO: 470 - protein, 15 aa, Homo sapiens
  SITE (1)..(15): One or more of the listed amino acids can be phosphorylated as set forth in the Tables
ASISRLSGEQVDGKG

SEQ ID NO: 471 - protein, 16 aa, Homo sapiens
  SITE (1)..(16): One or more of the listed amino acids can be phosphorylated as set forth in the Tables
ASISRLSGEQVDGKGQ

SEQ ID NO: 472 - protein, 12 aa, Homo sapiens
  SITE (1)..(12): One or more of the listed amino acids can be phosphorylated as set forth in the Tables
APSTYAHLSPAK

SEQ ID NO: 473 - protein, 17 aa, Homo sapiens
  SITE (1)..(17): One or more of the listed amino acids can be phosphorylated as set forth in the Tables
APSTYAHLSPAKTPPPP

SEQ ID NO: 474 - protein, 10 aa, Homo sapiens
  SITE (1)..(10): One or more of the listed amino acids can be phosphorylated as set forth in the Tables
KYSPGKLRGN

SEQ ID NO: 475 - protein, 12 aa, Homo sapiens
  SITE (1)..(12): One or more of the listed amino acids can be phosphorylated as set forth in the Tables
APPAYEKLSAEQ

SEQ ID NO: 476 - protein, 15 aa, Homo sapiens
  SITE (1)..(16): One or more of the listed amino acids can be phosphorylated as set forth in the Tables
APPAYEKLSAEQSPP

SEQ ID NO: 477 - protein, 16 aa, Homo sapiens
  SITE (1)..(16): One or more of the listed amino acids can be phosphorylated as set forth in the Tables
APPAYEKLSAEQSPPP

SEQ ID NO: 478 - protein, 17 aa, Homo sapiens
  SITE (1)..(17): One or more of the listed amino acids can be phosphorylated as set forth in the Tables
APPAYEKLSAEQSPPPY

SEQ ID NO: 479 - protein, 19 aa, Homo sapiens
  SITE (1)..(19): One or more of the listed amino acids can be phosphorylated as set forth in the Tables
SGGDDDWTHLSSKEVDPST

SEQ ID NO: 480 - protein, 20 aa, Homo sapiens
  SITE (1)..(20): One or more of the listed amino acids can be phosphorylated as set forth in the Tables
SGGDDDWTHLSSKEVDPSTG

SEQ ID NO: 481 - protein, 21 aa, Homo sapiens
  SITE (1)..(21): One or more of the listed amino acids can be phosphorylated as set forth in the Tables
SGGDDDWTHLSSKEVDPSTGE

SEQ ID NO: 482 - protein, 22 aa, Homo sapiens
  SITE (1)..(22): One or more of the listed amino acids can be phosphorylated as set forth in the Tables
SGGDDDWTHLSSKEVDPSTGEL

SEQ ID NO: 483 - protein, 23 aa, Homo sapiens
  SITE (1)..(23): One or more of the listed amino acids can be phosphorylated as set forth in the Tables
SGGDDDWTHLSSKEVDPSTGELQ

SEQ ID NO: 484 - protein, 17 aa, Homo sapiens
  SITE (1)..(17): One or more of the listed amino acids can be phosphorylated as set forth in the Tables
GGDDDWTHLSSKEVDPS

SEQ ID NO: 485 - protein, 19 aa, Homo sapiens
  SITE (1)..(19): One or more of the listed amino acids can be phosphorylated as set forth in the Tables
GGDDDWTHLSSKEVDPSTG

SEQ ID NO: 486 - protein, 14 aa, Homo sapiens
  SITE (1)..(14): One or more of the listed amino acids can be phosphorylated as set forth in the Tables
GDDDWTHLSSKEVD

SEQ ID NO: 487 - protein, 15 aa, Homo sapiens
  SITE (1)..(15): One or more of the listed amino acids can be phosphorylated as set forth in the Tables
GDDDWTHLSSKEVDP

SEQ ID NO: 488 - protein, 16 aa, Homo sapiens
  SITE (1)..(16): One or more of the listed amino acids can be phosphorylated as set forth in the Tables
GDDDWTHLSSKEVDPS

SEQ ID NO: 489 - protein, 17 aa, Homo sapiens
  SITE (1)..(17): One or more of the listed amino acids can be phosphorylated as set forth in the Tables
GDDDWTHLSSKEVDPST

SEQ ID NO: 490 - protein, 18 aa, Homo sapiens
  SITE (1)..(18): One or more of the listed amino acids can be phosphorylated as set forth in the Tables
GDDDWTHLSSKEVDPSTG

SEQ ID NO: 491 - protein, 14 aa, Homo sapiens
  SITE (1)..(14): One or more of the listed amino acids can be phosphorylated as set forth in the Tables
DDDWTHLSSKEVDP

SEQ ID NO: 492 - protein, 16 aa, Homo sapiens
  SITE (1)..(16): One or more of the listed amino acids can be phosphorylated as set forth in the Tables
DDDWTHLSSKEVDPST

SEQ ID NO: 493 - protein, 14 aa, Homo sapiens
  SITE (1)..(14): One or more of the listed amino acids can be phosphorylated as set forth in the Tables
DDWTHLSSKEVDPS

SEQ ID NO: 494 - protein, 13 aa, Homo sapiens
  SITE (1)..(13): One or more of the listed amino acids can be phosphorylated as set forth in the Tables
DWTHLSSKEVDPS

SEQ ID NO: 495 - protein, 15 aa, Homo sapiens
  SITE (1)..(15): One or more of the listed amino acids can be phosphorylated as set forth in the Tables
DWTHLSSKEVDPSTG

SEQ ID NO: 496 - protein, 12 aa, Homo sapiens
  SITE (1)..(12): One or more of the listed amino acids can be phosphorylated as set forth in the Tables
WTHLSSKEVDPS

SEQ ID NO: 497 - protein, 14 aa, Homo sapiens
  SITE (1)..(14): One or more of the listed amino acids can be phosphorylated as set forth in the Tables
WTHLSSKEVDPSTG

SEQ ID NO: 498 - protein, 13 aa, Homo sapiens
  SITE (1)..(13): One or more of the listed amino acids can be phosphorylated as set forth in the Tables
FVSKVMIGSPKKV

SEQ ID NO: 499 - protein, 12 aa, Homo sapiens
  SITE (1)..(12): One or more of the listed amino acids can be phosphorylated as set forth in the Tables
VSKVMIGSPKKV

SEQ ID NO: 500 - protein, 8 aa, Homo sapiens
  SITE (1)..(8): One or more of the listed amino acids can be phosphorylated as set forth in the Tables
VMIGSKKV

SEQ ID NO: 501 - protein, 22 aa, Homo sapiens
  SITE (1)..(22): One or more of the listed amino acids can be phosphorylated as set forth in the Tables
SKEDKNGHDGDTHQEDDGEKSD

SEQ ID NO: 502 - protein, 14 aa, Homo sapiens
  SITE (1)..(14): One or more of the listed amino acids can be phosphorylated as set forth in the Tables
SGGAQSPLRYLHVL

SEQ ID NO: 503 - protein, 28 aa, Homo sapiens
  SITE (1)..(28): One or more of the listed amino acids can be phosphorylated as set forth in the Tables
GSALGGGGAGLSGRASGGAQSPLRYLHV

SEQ ID NO: 504 - protein, 25 aa, Homo sapiens
  SITE (1)..(25): One or more of the listed amino acids can be phosphorylated as set forth in the Tables
LGGGGAGLSGRASGGAQSPLRYLHV

SEQ ID NO: 505 - protein, 17 aa, Homo sapiens
  SITE (1)..(17): One or more of the listed amino acids can be phosphorylated as set forth in the Tables
GSPTMVEKGLEPGVFTL

SEQ ID NO: 506 - protein, 18 aa, Homo sapiens
  SITE (1)..(18): One or more of the listed amino acids can be phosphorylated as set forth in the Tables
EGSPTMVEKGLEPGVFTL

SEQ ID NO: 507 - protein, 19 aa, Homo sapiens
  SITE (1)..(19): One or more of the listed amino acids can be phosphorylated as set forth in the Tables
EEGSPTMVEKGLEPGVFTL

SEQ ID NO: 508 - protein, 24 aa, Homo sapiens
  SITE (1)..(24): One or more of the listed amino acids can be phosphorylated as set forth in the Tables
EEMPENALPSDEDDKDPNDPYRAL

SEQ ID NO: 509 - protein, 11 aa, Homo sapiens
  SITE (1)..(11): One or more of the listed amino acids can be phosphorylated as set forth in the Tables
SNFKSPVKTIR

SEQ ID NO: 510 - protein, 13 aa, Homo sapiens
  SITE (1)..(13): One or more of the listed amino acids can be phosphorylated as set forth in the Tables
AASNFKSPVKTIR

SEQ ID NO: 511 - protein, 14 aa, Homo sapiens
  SITE (1)..(14): One or more of the listed amino acids can be phosphorylated as set forth in the Tables
QAASNFKSPVKTIR

SEQ ID NO: 512 - protein, 9 aa, Homo sapiens
  SITE (1)..(9): One or more of the listed amino acids can be phosphorylated as set forth in the Tables
FKSPVKTIR

SEQ ID NO: 513 - protein, 10 aa, Homo sapiens
  SITE (1)..(10): One or more of the listed amino acids can be phosphorylated as set forth in the Tables
NFKSPVKTIR

SEQ ID NO: 514 - protein, 12 aa, Homo sapiens
  SITE (1)..(12): One or more of the listed amino acids can be phosphorylated as set forth in the Tables
SSSPTHAKSAHV

SEQ ID NO: 515 - protein, 17 aa, Homo sapiens
  SITE (1)..(17): One or more of the listed amino acids can be phosphorylated as set forth in the Tables
YYTAGSSSPTHAKSAHV

SEQ ID NO: 516 - protein, 10 aa, Homo sapiens
  SITE (1)..(10): One or more of the listed amino acids can be phosphorylated as set forth in the Tables
RSYSPDHRQK

SEQ ID NO: 517 - protein, 17 aa, Homo sapiens
  SITE (1)..(17): One or more of the listed amino acids can be phosphorylated as set forth in the Tables
VRQSVTSFPDADAFHHQ

SEQ ID NO: 518 - protein, 13 aa, Homo sapiens
  SITE (1)..(13): One or more of the listed amino acids can be phosphorylated as set forth in the Tables
FDKHTLGDSDNES

SEQ ID NO: 519 - protein, 12 aa, Homo sapiens
  SITE (1)..(12): One or more of the listed amino acids can be phosphorylated as set forth in the Tables
FKMPQEKSPGYS

SEQ ID NO: 520 - protein, 14 aa, Homo sapiens
  SITE (1)..(14): One or more of the listed amino acids can be phosphorylated as set forth in the Tables
TKSVKALSSLHGDD

SEQ ID NO: 521 - protein, 16 aa, Homo sapiens
  SITE (1)..(16): One or more of the listed amino acids can be phosphorylated as set forth in the Tables
TKSVKALSSLHGDDQD

SEQ ID NO: 522 - protein, 13 aa, Homo sapiens
  SITE (1)..(13): One or more of the listed amino acids can be phosphorylated as set forth in the Tables
TTKSVKALSSLHG

SEQ ID NO: 523 - protein, 15 aa, Homo sapiens
  SITE (1)..(15): One or more of the listed amino acids can be phosphorylated as set forth in the Tables
TTKSVKALSSLHGDD

SEQ ID NO: 524 - protein, 16 aa, Homo sapiens
  SITE (1)..(16): One or more of the listed amino acids can be phosphorylated as set forth in the Tables
TTKSVKALSSLHGDDQ

SEQ ID NO: 525 - protein, 17 aa, Homo sapiens
  SITE (1)..(17): One or more of the listed amino acids can be phosphorylated as set forth in the Tables
TTKSVKALSSLHGDDQD

SEQ ID NO: 526 - protein, 18 aa, Homo sapiens
  SITE (1)..(18): One or more of the listed amino acids can be phosphorylated as set forth in the Tables
TTKSVKALSSLHGDDQDS

SEQ ID NO: 527 - protein, 15 aa, Homo sapiens
  SITE (1)..(15): One or more of the listed amino acids can be phosphorylated as set forth in the Tables
TKSVKALSSLHGDDQ

SEQ ID NO: 528 - protein, 14 aa, Homo sapiens
  SITE (1)..(14): One or more of the listed amino acids can be phosphorylated as set forth in the Tables
KSVKALSSLHGDDQ

SEQ ID NO: 529 - protein, 15 aa, Homo sapiens
  SITE (1)..(15): One or more of the listed amino acids can be phosphorylated as set forth in the Tables
KSVKALSSLHGDDQD

SEQ ID NO: 530 - protein, 20 aa, Homo sapiens
  SITE (1)..(20): One or more of the listed amino acids can be phosphorylated as set forth in the Tables
TTKSVKALSSLHGDDQDSED

SEQ ID NO: 531 - protein, 21 aa, Homo sapiens
  SITE (1)..(21): One or more of the listed amino acids can be phosphorylated as set forth in the Tables
TTKSVKALSSLHGDDQDSEDE

SEQ ID NO: 532 - protein, 19 aa, Homo sapiens
  SITE (1)..(19): One or more of the listed amino acids can be phosphorylated as set forth in the Tables
KSVKALSSLHGDDQDSEDE

SEQ ID NO: 533 - protein, 13 aa, Homo sapiens
  SITE (1)..(13): One or more of the listed amino acids can be phosphorylated as set forth in the Tables
KLVSFHDDSDEDL

SEQ ID NO: 534 - protein, 11 aa, Homo sapiens
  SITE (1)..(11more of the listed amino acids can be phosphorylated asset forth in the Tables
RVASPTSGVKR

SEQ ID NO: 535 - protein, 27 aa, Homo sapiens
  SITE (1)..(27): One or more of the listed amino acids can be phosphorylated as set forth in the Tables
VAMPVKKSPRRSSSDEQGLSYSSLKNV

SEQ ID NO: 536 - protein, 28 aa, Homo sapiens
  SITE (1)..(28): One or more of the listed amino acids can be phosphorylated as set forth in the Tables
QVAMPVKKSPRRSSSDEQGLSYSSLKNV

SEQ ID NO: 537 - protein, 19 aa, Homo sapiens
  SITE (1)..(19): One or more of the listed amino acids can be phosphorylated as set forth in the Tables
SSNGKMASRRSEEKEAGEI

SEQ ID NO: 538 - protein, 17 aa, Homo sapiens
  SITE (1)..(17): One or more of the listed amino acids can be phosphorylated as set forth in the Tables
SSNGKMASRRSEEKEAG

SEQ ID NO: 539 - protein, 23 aa, Homo sapiens
  SITE (1)..(23): One or more of the listed amino acids can be phosphorylated as set forth in the Tables
EGEEPTVYSDEEEPKDESARKND

SEQ ID NO: 540 - protein, 24 aa, Homo sapiens
  SITE (1)..(24): One or more of the listed amino acids can be phosphorylated as set forth in the Tables
KEGEEPTVYSDEEEPKDESARKND

SEQ ID NO: 541 - protein, 27 aa, Homo sapiens
  SITE (1)..(27): One or more of the listed amino acids can be phosphorylated as set forth in the Tables
ASKMTQPQSKSAFPLSRKNKGSGSLDG

SEQ ID NO: 542 - protein, 13 aa, Homo sapiens
  SITE (1)..(13): One or more of the listed amino acids can be phosphorylated as set forth in the Tables
NRAMRRVSSVPSR

SEQ ID NO: 543 - protein, 15 aa, Homo sapiens
  SITE (1)..(13): One or more of the listed amino acids can be phosphorylated as set forth in the Tables
NRAMRRVSSVPSRAQ

SEQ ID NO: 544 - protein, 19 aa, Homo sapiens
  SITE (1)..(19): One or more of the listed amino acids can be phosphorylated as set forth in the Tables
RPASPTAIRRIGSVTSRQT

SEQ ID NO: 545 - protein, 25 aa, Homo sapiens
  SITE (1)..(25): One or more of the listed amino acids can be phosphorylated as set forth in the Tables
APPPLVPAPRPSSPPRGPGPARADR

SEQ ID NO: 546 - protein, 15 aa, Homo sapiens
  SITE (1)..(15): One or more of the listed amino acids can be phosphorylated as set forth in the Tables
TIGEKKEPSDKSVDS

SEQ ID NO: 547 - protein, 15 aa, Homo sapiens
  SITE (1)..(15): One or more of the listed amino acids can be phosphorylated as set forth in the Tables
ERSPLLSQETAGQKP

SEQ ID NO: 548 - protein, 16 aa, Homo sapiens
  SITE (1)..(16): One or more of the listed amino acids can be phosphorylated as set forth in the Tables
ERSPLLSQETAGQKPL

SEQ ID NO: 549 - protein, 16 aa, Homo sapiens
  SITE (1)..(16): One or more of the listed amino acids can be phosphorylated as set forth in the Tables
GERSPLLSQETAGQKP

SEQ ID NO: 550 - protein, 17 aa, Homo sapiens
  SITE (1)..(17): One or more of the listed amino acids can be phosphorylated as set forth in the Tables
GERSPLLSQETAGQKPL

SEQ ID NO: 551 - protein, 12 aa, Homo sapiens
  SITE (1)..(12): One or more of the listed amino acids can be phosphorylated as set forth in the Tables
VLKSRKSSVTEE

SEQ ID NO: 552 - protein, 20 aa, Homo sapiens
  SITE (1)..(20): One or more of the listed amino acids can be phosphorylated as set forth in the Tables
SSPPFPVPVYTRQAPKQVIK

SEQ ID NO: 553 - protein, 11 aa, Homo sapiens
  SITE (1)..(11): One or more of the listed amino acids can be phosphorylated as set forth in the Tables
RRIDISPSTLR

SEQ ID NO: 554 - protein, 12 aa, Homo sapiens
  SITE (1)..(12): One or more of the listed amino acids can be phosphorylated as set forth in the Tables
RRIDISPSTLRK

SEQ ID NO: 555 - protein, 18 aa, Homo sapiens
  SITE (1)..(18): One or more of the listed amino acids can be phosphorylated as set forth in the Tables
DPTRRFFKVTPPPGSGPQ

SEQ ID NO: 556 - protein, 18 aa, Homo sapiens
  SITE (1)..(18): One or more of the listed amino acids can be phosphorylated as set forth in the Tables
SGPKPLFRRMSSLVGPTQ

SEQ ID NO: 557 - protein, 11 aa, Homo sapiens
  SITE (1)..(11): One or more of the listed amino acids can be phosphorylated as set forth in the Tables
GPKPLFRRMSS

SEQ ID NO: 558 - protein, 12 aa, Homo sapiens
  SITE (1)..(12): One or more of the listed amino acids can be phosphorylated as set forth in the Tables
GPKPLFRRMSSL

SEQ ID NO: 559 - protein, 13 aa, Homo sapiens
  SITE (1)..(13): One or more of the listed amino acids can be phosphorylated as set forth in the Tables
GPKPLFRRMSSLV

SEQ ID NO: 560 - protein, 14 aa, Homo sapiens
  SITE (1)..(14): One or more of the listed amino acids can be phosphorylated as set forth in the Tables
GPKPLFRRMSSLVG

SEQ ID NO: 561 - protein, 15 aa, Homo sapiens
  SITE (1)..(15): One or more of the listed amino acids can be phosphorylated as set forth in the Tables
GPKPLFRRMSSLVGP

SEQ ID NO: 562 - protein, 16 aa, Homo sapiens
  SITE (1)..(16): One or more of the listed amino acids can be phosphorylated as set forth in the Tables
GPKPLFRRMSSLVGPT

SEQ ID NO: 563 - protein, 17 aa, Homo sapiens
  SITE (1)..(17): One or more of the listed amino acids can be phosphorylated as set forth in the Tables
GPKPLFRRMSSLVGPTQ

SEQ ID NO: 564 - protein, 18 aa, Homo sapiens
  SITE (1)..(18): One or more of the listed amino acids can be phosphorylated as set forth in the Tables
GPKPLFRRMSSLVGPTQS

SEQ ID NO: 565 - protein, 9 aa, Homo sapiens
  SITE (1)..(9): One or more of the listed amino acids can be phosphorylated as set forth in the Tables
RAKSPISLK

SEQ ID NO: 566 - protein, 13 aa, Homo sapiens
  SITE (1)..(13): One or more of the listed amino acids can be phosphorylated as set forth in the Tables
ESSVRSQEDQLSR

SEQ ID NO: 567 - protein, 14 aa, Homo sapiens
  SITE (1)..(14): One or more of the listed amino acids can be phosphorylated as set forth in the Tables
ESSVRSQEDQLSRR

SEQ ID NO: 568 - protein, 18 aa, Homo sapiens
  SITE (1)..(18): One or more of the listed amino acids can be phosphorylated as set forth in the Tables
RSPEDEYELLMPHRISSH

SEQ ID NO: 569 - protein, 17 aa, Homo sapiens
  SITE (1)..(17): One or more of the listed amino acids can be phosphorylated as set forth in the Tables
SPEDEYELLMPHRISSH

SEQ ID NO: 570 - protein, 17 aa, Homo sapiens
  SITE (1)..(17): One or more of the listed amino acids can be phosphorylated as set forth in the Tables
SPEDEYELLMPHRISSH

SEQ ID NO: 571 - protein, 12 aa, Homo sapiens
  SITE (1)..(12): One or more of the listed amino acids can be phosphorylated as set forth in the Tables
ELLMPHRISSHF

SEQ ID NO: 572 - protein, 13 aa, Homo sapiens
  SITE (1)..(13: One or more of the listed amino acids can be phosphorylated as set forth in the Tables
ELLMPHRISSHFL

SEQ ID NO: 573 - protein, 19 aa, Homo sapiens
  SITE (1)..(19): One or more of the listed amino acids can be phosphorylated as set forth in the Tables
TPDPSKFFSQLSSEHGGDV

SEQ ID NO: 574 - protein, 20 aa, Homo sapiens
  SITE (1)..(20): One or more of the listed amino acids can be phosphorylated as set forth in the Tables
TPDPSKFFSQLSSEHGGDVQ

SEQ ID NO: 575 - protein, 15 aa, Homo sapiens
  SITE (1)..(15): One or more of the listed amino acids can be phosphorylated as set forth in the Tables
DKLSVIAEDSESGKQ

SEQ ID NO: 576 - protein, 16 aa, Homo sapiens
  SITE (1)..(16): One or more of the listed amino acids can be phosphorylated as set forth in the Tables
DKLSVIAEDSESGKQN

SEQ ID NO: 577 - protein, 17 aa, Homo sapiens
  SITE (1)..(17): One or more of the listed amino acids can be phosphorylated as set forth in the Tables
DKLSVIAEDSESGKQNP

SEQ ID NO: 578 - protein, 18 aa, Homo sapiens
  SITE (1)..(18): One or more of the listed amino acids can be phosphorylated as set forth in the Tables
DKLSVIAEDSESGKQNPG

SEQ ID NO: 579 - protein, 20 aa, Homo sapiens
  SITE (1)..(20): One or more of the listed amino acids can be phosphorylated as set forth in the Tables
DKLSVIAEDSESGKQNPGDS

SEQ ID NO: 580 - protein, 15 aa, Homo sapiens
  SITE (1)..(15): One or more of the listed amino acids can be phosphorylated as set forth in the Tables
KLSVIAEDSESGKQN

SEQ ID NO: 581 - protein, 16 aa, Homo sapiens
  SITE (1)..(16): One or more of the listed amino acids can be phosphorylated as set forth in the Tables
KLSVIAEDSESGKQNP

SEQ ID NO: 582 - protein, 17 aa, Homo sapiens
  SITE (1)..(17): One or more of the listed amino acids can be phosphorylated as set forth in the Tables
KLSVIAEDSESGKQNPG

SEQ ID NO: 583 - protein, 16 aa, Homo sapiens
  SITE (1)..(16): One or more of the listed amino acids can be phosphorylated as set forth in the Tables
ASPTIEAQGTSPAHDN

SEQ ID NO: 584 - protein, 17 aa, Homo sapiens
  SITE (1)..(17): One or more of the listed amino acids can be phosphorylated as set forth in the Tables
ASPTIEAQGTSPAHDNI

SEQ ID NO: 585 - protein, 18 aa, Homo sapiens
  SITE (1)..(18): One or more of the listed amino acids can be phosphorylated as set forth in the Tables
ASPTIEAQGTSPAHDNIA

SEQ ID NO: 586 - protein, 16 aa, Homo sapiens
  SITE (1)..(16): One or more of the listed amino acids can be phosphorylated as set forth in the Tables
SSSWRILGSKQSEHRP

SEQ ID NO: 587 - protein, 21 aa, Homo sapiens
  SITE (1)..(21): One or more of the listed amino acids can be phosphorylated as set forth in the Tables
NLELSKFRMPQPSSGRESPRH

SEQ ID NO: 588 - protein, 18 aa, Homo sapiens
  SITE (1)..(18): One or more of the listed amino acids can be phosphorylated as set forth in the Tables
LSKFRMPQPSSGRESPRH

SEQ ID NO: 589 - protein, 12 aa, Homo sapiens
  SITE (1)..(12): One or more of the listed amino acids can be phosphorylated as set forth in the Tables
SDFHAERAAREK

SEQ ID NO: 590 - protein, 18 aa, Homo sapiens
  SITE (1)..(18): One or more of the listed amino acids can be phosphorylated as set forth in the Tables
SPERPFLAILGGAKVADK

SEQ ID NO: 591 - protein, 20 aa, Homo sapiens
  SITE (1)..(20): One or more of the listed amino acids can be phosphorylated as set forth in the Tables
SPERPFLAILGGAKVADKIQ

SEQ ID NO: 592 - protein, 21 aa, Homo sapiens
  SITE (1)..(21): One or more of the listed amino acids can be phosphorylated as set forth in the Tables
PPLPEDSIKVIRNMRAASPPA

SEQ ID NO: 593 - protein, 11 aa, Homo sapiens
  SITE (1)..(11): One or more of the listed amino acids can be phosphorylated as set forth in the Tables
RTMSEAALVRK

SEQ ID NO: 594 - protein, 17 aa, Homo sapiens
  SITE (1)..(17): One or more of the listed amino acids can be phosphorylated as set forth in the Tables
MPRPSIKKAQNSQAARQ

SEQ ID NO: 595 - protein, 18 aa, Homo sapiens
  SITE (1)..(18): One or more of the listed amino acids can be phosphorylated as set forth in the Tables
TKDKYMASRGQKAKSMEG

SEQ ID NO: 596 - protein, 20 aa, Homo sapiens
  SITE (1)..(20): One or more of the listed amino acids can be phosphorylated as set forth in the Tables
THKGEIRGASTPFQFRASSP

SEQ ID NO: 597 - protein, 19 aa, Homo sapiens
  SITE (1)..(19): One or more of the listed amino acids can be phosphorylated as set forth in the Tables
HKGEIRGASTPFQFRASSP

SEQ ID NO: 598 - protein, 13 aa, Homo sapiens
  SITE (1)..(13): One or more of the listed amino acids can be phosphorylated as set forth in the Tables
VPHHGFEDWSQIR

SEQ ID NO: 599 - protein, 16 aa, Homo sapiens
  SITE (1)..(16): One or more of the listed amino acids can be phosphorylated as set forth in the Tables
KIEKIYIMKADTVIVG

SEQ ID NO: 600 - protein, 15 aa, Homo sapiens
  SITE (1)..(15): One or more of the listed amino acids can be phosphorylated as set forth in the Tables
IEKIYIMKADTVIVG

SEQ ID NO: 601 - protein, 10 aa, Homo sapiens
  SITE (1)..(10): One or more of the listed amino acids can be phosphorylated as set forth in the Tables
STIQNSPTKK

SEQ ID NO: 602 - protein, 13 aa, Homo sapiens
  SITE (1)..(13): One or more of the listed amino acids can be phosphorylated as set forth in the Tables
GTLRRSDSQQAVK

SEQ ID NO: 603 - protein, 14 aa, Homo sapiens
  SITE (1)..(14): One or more of the listed amino acids can be phosphorylated as set forth in the Tables
GTLRRSDSQQAVKS

SEQ ID NO: 604 - protein, 16 aa, Homo sapiens
  SITE (1)..(16): One or more of the listed amino acids can be phosphorylated as set forth in the Tables
GTLRRSDSQQAVKSPP

SEQ ID NO: 605 - protein, 10 aa, Homo sapiens
  SITE (1)..(10): One or more of the listed amino acids can be phosphorylated as set forth in the Tables
EESSDDGKKY

SEQ ID NO: 606 - protein, 8 aa, Homo sapiens
  SITE (1)..(8): One or more of the listed amino acids can be phosphorylated as set forth in the Tables
KNRSWKYN

SEQ ID NO: 607 - protein, 9 aa, Homo sapiens
  SITE (1)..(9): One or more of the listed amino acids can be phosphorylated as set forth in the Tables
KNRSWKYNQ

SEQ ID NO: 608 - protein, 14 aa, Homo sapiens
  SITE (1)..(14): One or more of the listed amino acids can be phosphorylated as set forth in the Tables
KNRSWKYNQSISLR

SEQ ID NO: 609 - protein, 16 aa, Homo sapiens
  SITE (1)..(16): One or more of the listed amino acids can be phosphorylated as set forth in the Tables
KNRSWKYNQSISLRRP

SEQ ID NO: 610 - protein, 13 aa, Homo sapiens
  SITE (1)..(13): One or more of the listed amino acids can be phosphorylated as set forth in the Tables
NRSWKYNQSISLR

SEQ ID NO: 611 - protein, 15 aa, Homo sapiens
  SITE (1)..(15): One or more of the listed amino acids can be phosphorylated as set forth in the Tables
NRSWKYNQSISLRRP

SEQ ID NO: 612 - protein, 14 aa, Homo sapiens
  SITE (1)..(14): One or more of the listed amino acids can be phosphorylated as set forth in the Tables
RSWKYNQSISLRRP

SEQ ID NO: 613 - protein, 10 aa, Artificial Sequence
  Artificially synthesized peptide
  SITE (1)..(10): One or more of the listed amino acids can be phosphorylated as set forth in the Tables
AMRSSPIMRK

SEQ ID NO: 614 - protein, 10 aa, Artificial Sequence
  Artificially synthesized peptide
  SITE (1)..(10): One or more of the listed amino acids can be phosphorylated as set forth in the Tables
ALRSSPIMRY

SEQ ID NO: 615 - protein, 9 aa, Artificial Sequence
  Artificially synthesized peptide
  SITE (1)..(9): One or more of the listed amino acids can be phosphorylated as set forth in the Tables
AMYSGVHKK

SEQ ID NO: 616 - protein, 9 aa, Artificial Sequence
  Artificially synthesized peptide
  SITE (1)..(9): One or more of the listed amino acids can be phosphorylated as set forth in the Tables
ALYSGVHKY

SEQ ID NO: 617 - protein, 10 aa, Artificial Sequence
  Artificially synthesized peptide
  SITE (1)..(10): One or more of the listed amino acids can be phosphorylated as set forth in the Tables
DLVPLSPLKK

SEQ ID NO: 618 - protein, 10 aa, Artificial Sequence
  Artificially synthesized peptide
  SITE (1)..(10): One or more of the listed amino acids can be phosphorylated as set forth in the Tables
DMVPLSPLKK

SEQ ID NO: 619 - protein, 10 aa, Artificial Sequence
  Artificially synthesized peptide
  SITE (1)..(10): One or more of the listed amino acids can be phosphorylated as set forth in the Tables
ELKKSPTSLK

SEQ ID NO: 620 - protein, 10 aa, Artificial Sequence
  Artificially synthesized peptide
  SITE (1)..(10): One or more of the listed amino acids can be phosphorylated as set forth in the Tables
ELKKSPTSLY

SEQ ID NO: 621 - protein, 9 aa, Artificial Sequence
  Artificially synthesized peptide
  SITE (1)..(9): One or more of the listed amino acids can be phosphorylated as set forth in the Tables
FRYSGKTEK

SEQ ID NO: 622 - protein, 9 aa, Artificial Sequence
  Artificially synthesized peptide
  SITE (1)..(9): One or more of the listed amino acids can be phosphorylated as set forth in the Tables
FLYSGKETK

SEQ ID NO: 623 - protein, 9 aa, Artificial Sequence
  Artificially synthesized peptide
  SITE (1)..(9): One or more of the listed amino acids can be phosphorylated as set forth in the Tables
FLYSGKETY

SEQ ID NO: 624 - protein, 9 aa, Artificial Sequence
  Artificially synthesized peptide
  SITE (1)..(9): One or more of the listed amino acids can be phosphorylated as set forth in the Tables
IISSPLKGY

SEQ ID NO: 625 - protein, 9 aa, Artificial Sequence
  Artificially synthesized peptide
  SITE (1)..(9): One or more of the listed amino acids can be phosphorylated as set forth in the Tables
ITQGTPLKK

SEQ ID NO: 626 - protein, 11 aa, Artificial Sequence
  Artificially synthesized peptide
  SITE (1)..(11): One or more of the listed amino acids can be phosphorylated as set forth in the Tables
KLISSSSLKEK

SEQ ID NO: 627 - protein, 11 aa, Artificial Sequence
  Artificially synthesized peptide
  SITE (1)..(11): One or more of the listed amino acids can be phosphorylated as set forth in the Tables
KMISSSSLKEK

SEQ ID NO: 628 - protein, 11 aa, Artificial Sequence
  Artificially synthesized peptide
  SITE (1)..(11): One or more of the listed amino acids can be phosphorylated as set forth in the Tables
KLISSSSLKEY

SEQ ID NO: 629 - protein, 10 aa, Artificial Sequence
  Artificially synthesized peptide
  SITE (1)..(10): One or more of the listed amino acids can be phosphorylated as set forth in the Tables
KLDSPTKVKK

SEQ ID NO: 630 - protein, 10 aa, Artificial Sequence
  Artificially synthesized peptide
  SITE (1)..(10): One or more of the listed amino acids can be phosphorylated as set forth in the Tables
KMDSPTKVKK

SEQ ID NO: 631 - protein, 10 aa, Artificial Sequence
  Artificially synthesized peptide
  SITE (1)..(10): One or more of the listed amino acids can be phosphorylated as set forth in the Tables
KLDSPTKVKY

SEQ ID NO: 632 - protein, 9 aa, Artificial Sequence
  Artificially synthesized peptide
  SITE (1)..(9): One or more of the listed amino acids can be phosphorylated as set forth in the Tables
KLFSKQQGK

SEQ ID NO: 633 - protein, 9 aa, Artificial Sequence
  Artificially synthesized peptide
  SITE (1)..(9): One or more of the listed amino acids can be phosphorylated as set forth in the Tables
KMFSKQQGK

SEQ ID NO: 634 - protein, 9 aa, Artificial Sequence
  Artificially synthesized peptide
  SITE (1)..(9): One or more of the listed amino acids can be phosphorylated as set forth in the Tables
KLFSKQQGY

SEQ ID NO: 635 - protein, 9 aa, Artificial Sequence
  Artificially synthesized peptide
  SITE (1)..(9): One or more of the listed amino acids can be phosphorylated as set forth in the Tables
KIFSKQQGY

SEQ ID NO: 636 - protein, 10 aa, Artificial Sequence
  Artificially synthesized peptide
  SITE (1)..(10): One or more of the listed amino acids can be phosphorylated as set forth in the Tables
KLRSSPREAK

SEQ ID NO: 637 - protein, 10 aa, Artificial Sequence
  Artificially synthesized peptide
  SITE (1)..(10): One or more of the listed amino acids can be phosphorylated as set forth in the Tables
KMRSSPREAK

SEQ ID NO: 638 - protein, 10 aa, Artificial Sequence
  Artificially synthesized peptide
  SITE (1)..(10): One or more of the listed amino acids can be phosphorylated as set forth in the Tables
KIRSSPREAY

SEQ ID NO: 639 - protein, 9 aa, Artificial Sequence
  Artificially synthesized peptide
  SITE (1)..(9): One or more of the listed amino acids can be phosphorylated as set forth in the Tables
KLRTSPTFK

SEQ ID NO: 640 - protein, 9 aa, Artificial Sequence
  Artificially synthesized peptide
  SITE (1)..(9): One or more of the listed amino acids can be phosphorylated as set forth in the Tables
KMRTSPTFK

SEQ ID NO: 641 - protein, 9 aa, Artificial Sequence
  Artificially synthesized peptide
  SITE (1)..(9): One or more of the listed amino acids can be phosphorylated as set forth in the Tables
KIRTSPTFY

SEQ ID NO: 642 - protein, 9 aa, Artificial Sequence
  Artificially synthesized peptide
  SITE (1)..(9): One or more of the listed amino acids can be phosphorylated as set forth in the Tables
KMFSPAHKK

SEQ ID NO: 643 - protein, 9 aa, Artificial Sequence
  Artificially synthesized peptide
  SITE (1)..(9): One or more of the listed amino acids can be phosphorylated as set forth in the Tables
KLFSPAHKY

SEQ ID NO: 644 - protein, 9 aa, Artificial Sequence
  Artificially synthesized peptide
  SITE (1)..(9): One or more of the listed amino acids can be phosphorylated as set forth in the Tables
KMRSPFLQK

SEQ ID NO: 645 - protein, 9 aa, Artificial Sequence
  Artificially synthesized peptide
  SITE (1)..(9): One or more of the listed amino acids can be phosphorylated as set forth in the Tables
KLRSPFLQY

SEQ ID NO: 646 - protein, 11 aa, Artificial Sequence
  Artificially synthesized peptide
  SITE (1)..(11): One or more of the listed amino acids can be phosphorylated as set forth in the Tables
KMSSPRGGMKK

SEQ ID NO: 647 - protein, 10 aa, Artificial Sequence
  Artificially synthesized peptide
  SITE (1)..(10): One or more of the listed amino acids can be phosphorylated as set forth in the Tables
KLSSPRGGMK

SEQ ID NO: 648 - protein, 11 aa, Artificial Sequence
  Artificially synthesized peptide
  SITE (1)..(11): One or more of the listed amino acids can be phosphorylated as set forth in the Tables
KLSSPRGGMKY

SEQ ID NO: 649 - protein, 10 aa, Artificial Sequence
  Artificially synthesized peptide
  SITE (1)..(10): One or more of the listed amino acids can be phosphorylated as set forth in the Tables
KLPTTPVKAK

SEQ ID NO: 650 - protein, 10 aa, Artificial Sequence
  Artificially synthesized peptide
  SITE (1)..(10): One or more of the listed amino acids can be phosphorylated as set forth in the Tables
KMPTTPVKAY

SEQ ID NO: 651 - protein, 9 aa, Artificial Sequence
  Artificially synthesized peptide
  SITE (1)..(9): One or more of the listed amino acids can be phosphorylated as set forth in the Tables
KLLSVERIK

SEQ ID NO: 652 - protein, 9 aa, Artificial Sequence
  Artificially synthesized peptide
  SITE (1)..(9): One or more of the listed amino acids can be phosphorylated as set forth in the Tables
KMLSVERIK

SEQ ID NO: 653 - protein, 9 aa, Artificial Sequence
  Artificially synthesized peptide
  SITE (1)..(9): One or more of the listed amino acids can be phosphorylated as set forth in the Tables
KLFSGTVRK

SEQ ID NO: 654 - protein, 9 aa, Artificial Sequence
  Artificially synthesized peptide
  SITE (1)..(9): One or more of the listed amino acids can be phosphorylated as set forth in the Tables
KMFSGTVRK

SEQ ID NO: 655 - protein, 9 aa, Artificial Sequence
  Artificially synthesized peptide
  SITE (1)..(9): One or more of the listed amino acids can be phosphorylated as set forth in the Tables
KLYSGNMEK

SEQ ID NO: 656 - protein, 9 aa, Artificial Sequence
  Artificially synthesized peptide
  SITE (1)..(9): One or more of the listed amino acids can be phosphorylated as set forth in the Tables
KMYSGNMEK

SEQ ID NO: 657 - protein, 11 aa, Artificial Sequence
  Artificially synthesized peptide
  SITE (1)..(11): One or more of the listed amino acids can be phosphorylated as set forth in the Tables
KLKSNPDFLKK

SEQ ID NO: 658 - protein, 11 aa, Artificial Sequence
  Artificially synthesized peptide
  SITE (1)..(11): One or more of the listed amino acids can be phosphorylated as set forth in the Tables
KMKSNPDFLKK

SEQ ID NO: 659 - protein, 11 aa, Artificial Sequence
  Artificially synthesized peptide
  SITE (1)..(11): One or more of the listed amino acids can be phosphorylated as set forth in the Tables
KMKSNPDFLKY

SEQ ID NO: 660 - protein, 11 aa, Artificial Sequence
  Artificially synthesized peptide
  SITE (1)..(11): One or more of the listed amino acids can be phosphorylated as set forth in the Tables
KLKSNPDFLKY

SEQ ID NO: 661 - protein, 9 aa, Artificial Sequence
  Artificially synthesized peptide
  SITE (1)..(9): One or more of the listed amino acids can be phosphorylated as set forth in the Tables
KSKTPLVAK

SEQ ID NO: 662 - protein, 9 aa, Artificial Sequence
  Artificially synthesized peptide
  SITE (1)..(9): One or more of the listed amino acids can be phosphorylated as set forth in the Tables
KLKTPLVAR

SEQ ID NO: 663 - protein, 9 aa, Artificial Sequence
  Artificially synthesized peptide
  SITE (1)..(9): One or more of the listed amino acids can be phosphorylated as set forth in the Tables
KMKTPLVAR

SEQ ID NO: 664 - protein, 9 aa, Artificial Sequence
  Artificially synthesized peptide
  SITE (1)..(9): One or more of the listed amino acids can be phosphorylated as set forth in the Tables
KLKTPLVAK

SEQ ID NO: 665 - protein, 9 aa, Artificial Sequence
  Artificially synthesized peptide
  SITE (1)..(9): One or more of the listed amino acids can be phosphorylated as set forth in the Tables
KMKTPLVAK

SEQ ID NO: 666 - protein, 9 aa, Artificial Sequence
  Artificially synthesized peptide
  SITE (1)..(9): One or more of the listed amino acids can be phosphorylated as set forth in the Tables
KSKTPLVAY

SEQ ID NO: 667 - protein, 10 aa, Artificial Sequence
  Artificially synthesized peptide
  SITE (1)..(10): One or more of the listed amino acids can be phosphorylated as set forth in the Tables
KLSSLGNLKK

SEQ ID NO: 668 - protein, 10 aa, Artificial Sequence
  Artificially synthesized peptide
  SITE (1)..(10): One or more of the listed amino acids can be phosphorylated as set forth in the Tables
KMSSLGNLKK

SEQ ID NO: 669 - protein, 10 aa, Artificial Sequence
  Artificially synthesized peptide
  SITE (1)..(10): One or more of the listed amino acids can be phosphorylated as set forth in the Tables
KLSSLGNLKY

SEQ ID NO: 670 - protein, 10 aa, Artificial Sequence
  Artificially synthesized peptide
  SITE (1)..(10): One or more of the listed amino acids can be phosphorylated as set forth in the Tables
KMSSLGNLKY

SEQ ID NO: 671 - protein, 12 aa, Artificial Sequence
  Artificially synthesized peptide
  SITE (1)..(12): One or more of the listed amino acids can be phosphorylated as set forth in the Tables
KTLSPGKNGVVY

SEQ ID NO: 672 - protein, 10 aa, Artificial Sequence
  Artificially synthesized peptide
  SITE (1)..(10): One or more of the listed amino acids can be phosphorylated as set forth in the Tables
KLPTSPLKMK

SEQ ID NO: 673 - protein, 10 aa, Artificial Sequence
  Artificially synthesized peptide
  SITE (1)..(10): One or more of the listed amino acids can be phosphorylated as set forth in the Tables
KMPTSPLKMK

SEQ ID NO: 674 - protein, 10 aa, Artificial Sequence
  Artificially synthesized peptide
  SITE (1)..(10): One or more of the listed amino acids can be phosphorylated as set forth in the Tables
KTPTSPLKMY

SEQ ID NO: 675 - protein, 11 aa, Artificial Sequence
  Artificially synthesized peptide
  SITE (1)..(11): One or more of the listed amino acids can be phosphorylated as set forth in the Tables
KLHGSLARAGK

SEQ ID NO: 676 - protein, 11 aa, Artificial Sequence
  Artificially synthesized peptide
  SITE (1)..(11): One or more of the listed amino acids can be phosphorylated as set forth in the Tables
KLHGSLARAGY

SEQ ID NO: 677 - protein, 11 aa, Artificial Sequence
  Artificially synthesized peptide
  SITE (1)..(11): One or more of the listed amino acids can be phosphorylated as set forth in the Tables
KVHGSLARAGY

SEQ ID NO: 678 - protein, 9 aa, Artificial Sequence
  Artificially synthesized peptide
  SITE (1)..(9): One or more of the listed amino acids can be phosphorylated as set forth in the Tables
KLLTPIKEK

SEQ ID NO: 679 - protein, 9 aa, Artificial Sequence
  Artificially synthesized peptide
  SITE (1)..(9): One or more of the listed amino acids can be phosphorylated as set forth in the Tables
KMLTPIKEK

SEQ ID NO: 680 - protein, 9 aa, Artificial Sequence
  Artificially synthesized peptide
  SITE (1)..(9): One or more of the listed amino acids can be phosphorylated as set forth in the Tables
KVLTPIKEY

SEQ ID NO: 681 - protein, 9 aa, Artificial Sequence
  Artificially synthesized peptide
  SITE (1)..(9): One or more of the listed amino acids can be phosphorylated as set forth in the Tables
KLLTPIKEY

SEQ ID NO: 682 - protein, 11 aa, Artificial Sequence
  Artificially synthesized peptide
  SITE (1)..(11): One or more of the listed amino acids can be phosphorylated as set forth in the Tables
KLHGSLARAGK

SEQ ID NO: 683 - protein, 11 aa, Artificial Sequence
  Artificially synthesized peptide
  SITE (1)..(11): One or more of the listed amino acids can be phosphorylated as set forth in the Tables
KMHGSLARAGK

SEQ ID NO: 684 - protein, 11 aa, Artificial Sequence
  Artificially synthesized peptide
  SITE (1)..(11): One or more of the listed amino acids can be phosphorylated as set forth in the Tables
KVHGSLARAGY

SEQ ID NO: 685 - protein, 10 aa, Artificial Sequence
  Artificially synthesized peptide
  SITE (1)..(10): One or more of the listed amino acids can be phosphorylated as set forth in the Tables
LMNKSSPVKK

SEQ ID NO: 686 - protein, 10 aa, Artificial Sequence
  Artificially synthesized peptide
  SITE (1)..(10): One or more of the listed amino acids can be phosphorylated as set forth in the Tables
LLNKSSPVKY

SEQ ID NO: 687 - protein, 10 aa, Artificial Sequence
  Artificially synthesized peptide
  SITE (1)..(10): One or more of the listed amino acids can be phosphorylated as set forth in the Tables
LMNKSSPVKY

SEQ ID NO: 688 - protein, 10 aa, Artificial Sequence
  Artificially synthesized peptide
  SITE (1)..(10): One or more of the listed amino acids can be phosphorylated as set forth in the Tables
MLRSPPRVSK

SEQ ID NO: 689 - protein, 10 aa, Artificial Sequence
  Artificially synthesized peptide
  SITE (1)..(10): One or more of the listed amino acids can be phosphorylated as set forth in the Tables
MMRSPPRVSK

SEQ ID NO: 690 - protein, 10 aa, Artificial Sequence
  Artificially synthesized peptide
  SITE (1)..(10): One or more of the listed amino acids can be phosphorylated as set forth in the Tables
MTRSPPRVSY

SEQ ID NO: 691 - protein, 9 aa, Artificial Sequence
  Artificially synthesized peptide
  SITE (1)..(9): One or more of the listed amino acids can be phosphorylated as set forth in the Tables
NLVERKNSL

SEQ ID NO: 692 - protein, 9 aa, Artificial Sequence
  Artificially synthesized peptide
  SITE (1)..(9): One or more of the listed amino acids can be phosphorylated as set forth in the Tables
NMVERKNSL

SEQ ID NO: 693 - protein, 9 aa, Artificial Sequence
  Artificially synthesized peptide
  SITE (1)..(9): One or more of the listed amino acids can be phosphorylated as set forth in the Tables
NLVERKNSK

SEQ ID NO: 694 - protein, 9 aa, Artificial Sequence
  Artificially synthesized peptide
  SITE (1)..(9): One or more of the listed amino acids can be phosphorylated as set forth in the Tables
NMVERKNSK

SEQ ID NO: 695 - protein, 9 aa, Artificial Sequence
  Artificially synthesized peptide
  SITE (1)..(9): One or more of the listed amino acids can be phosphorylated as set forth in the Tables
NYVERKNSK

SEQ ID NO: 696 - protein, 9 aa, Artificial Sequence
  Artificially synthesized peptide
  SITE (1)..(9): One or more of the listed amino acids can be phosphorylated as set forth in the Tables
NYVERKNSY

SEQ ID NO: 697 - protein, 10 aa, Artificial Sequence
  Artificially synthesized peptide
  SITE (1)..(10): One or more of the listed amino acids can be phosphorylated as set forth in the Tables
QLFSPKKGQK

SEQ ID NO: 698 - protein, 10 aa, Artificial Sequence
  Artificially synthesized peptide
  SITE (1)..(10): One or more of the listed amino acids can be phosphorylated as set forth in the Tables
QMFSPKKGQK

SEQ ID NO: 699 - protein, 10 aa, Artificial Sequence
  Artificially synthesized peptide
  SITE (1)..(10): One or more of the listed amino acids can be phosphorylated as set forth in the Tables
QVFSPKKGQY

SEQ ID NO: 700 - protein, 10 aa, Artificial Sequence
  Artificially synthesized peptide
  SITE (1)..(10): One or more of the listed amino acids can be phosphorylated as set forth in the Tables
RLFSFSKTPK

SEQ ID NO: 701 - protein, 10 aa, Artificial Sequence
  Artificially synthesized peptide
  SITE (1)..(10): One or more of the listed amino acids can be phosphorylated as set forth in the Tables
RMFSFSKTPK

SEQ ID NO: 702 - protein, 10 aa, Artificial Sequence
  Artificially synthesized peptide
  SITE (1)..(10): One or more of the listed amino acids can be phosphorylated as set forth in the Tables
RAFSFSKTPY

SEQ ID NO: 703 - protein, 10 aa, Artificial Sequence
  Artificially synthesized peptide
  SITE (1)..(10): One or more of the listed amino acids can be phosphorylated as set forth in the Tables
RLLSPSMASK

SEQ ID NO: 704 - protein, 10 aa, Artificial Sequence
  Artificially synthesized peptide
  SITE (1)..(10): One or more of the listed amino acids can be phosphorylated as set forth in the Tables
RMLSPSMASK

SEQ ID NO: 705 - protein, 10 aa, Artificial Sequence
  Artificially synthesized peptide
  SITE (1)..(10): One or more of the listed amino acids can be phosphorylated as set forth in the Tables
RILSPSMASY

SEQ ID NO: 706 - protein, 9 aa, Artificial Sequence
  Artificially synthesized peptide
  SITE (1)..(9): One or more of the listed amino acids can be phosphorylated as set forth in the Tables
RLYQYIQSR

SEQ ID NO: 707 - protein, 9 aa, Artificial Sequence
  Artificially synthesized peptide
  SITE (1)..(9): One or more of the listed amino acids can be phosphorylated as set forth in the Tables
RMYQYIQSR

SEQ ID NO: 708 - protein, 9 aa, Artificial Sequence
  Artificially synthesized peptide
  SITE (1)..(9): One or more of the listed amino acids can be phosphorylated as set forth in the Tables
RLYQYIQSK

SEQ ID NO: 709 - protein, 9 aa, Artificial Sequence
  Artificially synthesized peptide
  SITE (1)..(9): One or more of the listed amino acids can be phosphorylated as set forth in the Tables
RMYQYIQSK

SEQ ID NO: 710 - protein, 9 aa, Artificial Sequence
  Artificially synthesized peptide
  SITE (1)..(9): One or more of the listed amino acids can be phosphorylated as set forth in the Tables
RIYQYIQSY

SEQ ID NO: 711 - protein, 10 aa, Artificial Sequence
  Artificially synthesized peptide
  SITE (1)..(10): One or more of the listed amino acids can be phosphorylated as set forth in the Tables
RLYQYLQSRF

SEQ ID NO: 712 - protein, 10 aa, Artificial Sequence
  Artificially synthesized peptide
  SITE (1)..(10): One or more of the listed amino acids can be phosphorylated as set forth in the Tables
RMYQYLQSRF

SEQ ID NO: 713 - protein, 10 aa, Artificial Sequence
  Artificially synthesized peptide
  SITE (1)..(10): One or more of the listed amino acids can be phosphorylated as set forth in the Tables
RLYQYLQSRK

SEQ ID NO: 714 - protein, 10 aa, Artificial Sequence
  Artificially synthesized peptide
  SITE (1)..(10): One or more of the listed amino acids can be phosphorylated as set forth in the Tables
RMYQYLQSRK

SEQ ID NO: 715 - protein, 11 aa, Artificial Sequence
  Artificially synthesized peptide
  SITE (1)..(11): One or more of the listed amino acids can be phosphorylated as set forth in the Tables
RLYQYLQSRFY

SEQ ID NO: 716 - protein, 11 aa, Artificial Sequence
  Artificially synthesized peptide
  SITE (1)..(11): One or more of the listed amino acids can be phosphorylated as set forth in the Tables
RMYQYLQSRFY

SEQ ID NO: 717 - protein, 11 aa, Artificial Sequence
  Artificially synthesized peptide
  SITE (1)..(11): One or more of the listed amino acids can be phosphorylated as set forth in the Tables
RLYQYLQSRFK

SEQ ID NO: 718 - protein, 11 aa, Artificial Sequence
  Artificially synthesized peptide
  SITE (1)..(11): One or more of the listed amino acids can be phosphorylated as set forth in the Tables
RMYQYLQSRFK

SEQ ID NO: 719 - protein, 9 aa, Artificial Sequence
  Artificially synthesized peptide
  SITE (1)..(9): One or more of the listed amino acids can be phosphorylated as set forth in the Tables
RKLSVILIK

SEQ ID NO: 720 - protein, 9 aa, Artificial Sequence
  Artificially synthesized peptide
  SITE (1)..(9): One or more of the listed amino acids can be phosphorylated as set forth in the Tables
RLLSVILIK

SEQ ID NO: 721 - protein, 9 aa, Artificial Sequence
  Artificially synthesized peptide
  SITE (1)..(9): One or more of the listed amino acids can be phosphorylated as set forth in the Tables
RMLSVILIK

SEQ ID NO: 722 - protein, 9 aa, Artificial Sequence
  Artificially synthesized peptide
  SITE (1)..(9): One or more of the listed amino acids can be phosphorylated as set forth in the Tables
RKLSVILIY

SEQ ID NO: 723 - protein, 9 aa, Artificial Sequence
  Artificially synthesized peptide
  SITE (1)..(9): One or more of the listed amino acids can be phosphorylated as set forth in the Tables
RMISPYKKK

SEQ ID NO: 724 - protein, 9 aa, Artificial Sequence
  Artificially synthesized peptide
  SITE (1)..(9): One or more of the listed amino acids can be phosphorylated as set forth in the Tables
RMKSPFRKK

SEQ ID NO: 725 - protein, 12 aa, Artificial Sequence
  Artificially synthesized peptide
  SITE (1)..(12): One or more of the listed amino acids can be phosphorylated as set forth in the Tables
RMLDRSPSRSAK

SEQ ID NO: 726 - protein, 9 aa, Artificial Sequence
  Artificially synthesized peptide
  SITE (1)..(9): One or more of the listed amino acids can be phosphorylated as set forth in the Tables
RLPSSTLKK

SEQ ID NO: 727 - protein, 9 aa, Artificial Sequence
  Artificially synthesized peptide
  SITE (1)..(9): One or more of the listed amino acids can be phosphorylated as set forth in the Tables
RMPSSTLKK

SEQ ID NO: 728 - protein, 9 aa, Artificial Sequence
  Artificially synthesized peptide
  SITE (1)..(9): One or more of the listed amino acids can be phosphorylated as set forth in the Tables
RMPSSTLKR

SEQ ID NO: 729 - protein, 10 aa, Artificial Sequence
  Artificially synthesized peptide
  SITE (1)..(10): One or more of the listed amino acids can be phosphorylated as set forth in the Tables
RMRSAGAAQK

SEQ ID NO: 730 - protein, 9 aa, Artificial Sequence
  Artificially synthesized peptide
  SITE (1)..(9): One or more of the listed amino acids can be phosphorylated as set forth in the Tables
RLSSPISKK

SEQ ID NO: 731 - protein, 9 aa, Artificial Sequence
  Artificially synthesized peptide
  SITE (1)..(9): One or more of the listed amino acids can be phosphorylated as set forth in the Tables
RMSSPISKR

SEQ ID NO: 732 - protein, 9 aa, Artificial Sequence
  Artificially synthesized peptide
  SITE (1)..(9): One or more of the listed amino acids can be phosphorylated as set forth in the Tables
RMSSPISKK

SEQ ID NO: 733 - protein, 9 aa, Artificial Sequence
  Artificially synthesized peptide
  SITE (1)..(9): One or more of the listed amino acids can be phosphorylated as set forth in the Tables
RLSSPISKY

SEQ ID NO: 734 - protein, 9 aa, Artificial Sequence
  Artificially synthesized peptide
  SITE (1)..(9): One or more of the listed amino acids can be phosphorylated as set forth in the Tables
RLSSPVLHK

SEQ ID NO: 735 - protein, 9 aa, Artificial Sequence
  Artificially synthesized peptide
  SITE (1)..(9): One or more of the listed amino acids can be phosphorylated as set forth in the Tables
RMSSPVLHK

SEQ ID NO: 736 - protein, 9 aa, Artificial Sequence
  Artificially synthesized peptide
  SITE (1)..(9): One or more of the listed amino acids can be phosphorylated as set forth in the Tables
RLSSPVLHY

SEQ ID NO: 737 - protein, 9 aa, Artificial Sequence
  Artificially synthesized peptide
  SITE (1)..(9): One or more of the listed amino acids can be phosphorylated as set forth in the Tables
RMSSRYSQK

SEQ ID NO: 738 - protein, 9 aa, Artificial Sequence
  Artificially synthesized peptide
  SITE (1)..(9): One or more of the listed amino acids can be phosphorylated as set forth in the Tables
RLSSRYSQY

SEQ ID NO: 739 - protein, 9 aa, Artificial Sequence
  Artificially synthesized peptide
  SITE (1)..(9): One or more of the listed amino acids can be phosphorylated as set forth in the Tables
RMYSKSRDK

SEQ ID NO: 740 - protein, 9 aa, Artificial Sequence
  Artificially synthesized peptide
  SITE (1)..(9): One or more of the listed amino acids can be phosphorylated as set forth in the Tables
RMYSKSRDY

SEQ ID NO: 741 - protein, 9 aa, Artificial Sequence
  Artificially synthesized peptide
  SITE (1)..(9): One or more of the listed amino acids can be phosphorylated as set forth in the Tables
RLYSKSRDK

SEQ ID NO: 742 - protein, 9 aa, Artificial Sequence
  Artificially synthesized peptide
  SITE (1)..(9): One or more of the listed amino acids can be phosphorylated as set forth in the Tables
RRPSLVHGK

SEQ ID NO: 743 - protein, 9 aa, Artificial Sequence
  Artificially synthesized peptide
  SITE (1)..(9): One or more of the listed amino acids can be phosphorylated as set forth in the Tables
RLPSLVHGY

SEQ ID NO: 744 - protein, 11 aa, Artificial Sequence
  Artificially synthesized peptide
  SITE (1)..(10): One or more of the listed amino acids can be phosphorylated as set forth in the Tables
RLASSATQVHK

SEQ ID NO: 745 - protein, 11 aa, Artificial Sequence
  Artificially synthesized peptide
  SITE (1)..(11): One or more of the listed amino acids can be phosphorylated as set forth in the Tables
RMASSATQVHK

SEQ ID NO: 746 - protein, 11 aa, Artificial Sequence
  Artificially synthesized peptide
  SITE (1)..(11): One or more of the listed amino acids can be phosphorylated as set forth in the Tables
RSASSATQVHY

SEQ ID NO: 747 - protein, 9 aa, Artificial Sequence
  Artificially synthesized peptide
  SITE (1)..(9): One or more of the listed amino acids can be phosphorylated as set forth in the Tables
RLLSVEIVY

SEQ ID NO: 748 - protein, 9 aa, Artificial Sequence
  Artificially synthesized peptide
  SITE (1)..(9): One or more of the listed amino acids can be phosphorylated as set forth in the Tables
RSLSVEIVK

SEQ ID NO: 749 - protein, 9 aa, Artificial Sequence
  Artificially synthesized peptide
  SITE (1)..(9): One or more of the listed amino acids can be phosphorylated as set forth in the Tables
RLLSVEIVK

SEQ ID NO: 750 - protein, 9 aa, Artificial Sequence
  Artificially synthesized peptide
  SITE (1)..(9): One or more of the listed amino acids can be phosphorylated as set forth in the Tables
RSMSMPVAK

SEQ ID NO: 751 - protein, 9 aa, Artificial Sequence
  Artificially synthesized peptide
  SITE (1)..(9): One or more of the listed amino acids can be phosphorylated as set forth in the Tables
RLMSMPVAK

SEQ ID NO: 752 - protein, 9 aa, Artificial Sequence
  Artificially synthesized peptide
  SITE (1)..(9): One or more of the listed amino acids can be phosphorylated as set forth in the Tables
RLMSMPVAY

SEQ ID NO: 753 - protein, 9 aa, Artificial Sequence
  Artificially synthesized peptide
  SITE (1)..(9): One or more of the listed amino acids can be phosphorylated as set forth in the Tables
RLRRSPLLK

SEQ ID NO: 754 - protein, 9 aa, Artificial Sequence
  Artificially synthesized peptide
  SITE (1)..(9): One or more of the listed amino acids can be phosphorylated as set forth in the Tables
RMRRSPLLK

SEQ ID NO: 755 - protein, 9 aa, Artificial Sequence
  Artificially synthesized peptide
  SITE (1)..(9): One or more of the listed amino acids can be phosphorylated as set forth in the Tables
RSRRSPLLY

SEQ ID NO: 756 - protein, 10 aa, Artificial Sequence
  Artificially synthesized peptide
  SITE (1)..(10): One or more of the listed amino acids can be phosphorylated as set forth in the Tables
RLRSPPPVSK

SEQ ID NO: 757 - protein, 10 aa, Artificial Sequence
  Artificially synthesized peptide
  SITE (1)..(10): One or more of the listed amino acids can be phosphorylated as set forth in the Tables
RMRSPPPVSK

SEQ ID NO: 758 - protein, 10 aa, Artificial Sequence
  Artificially synthesized peptide
  SITE (1)..(10): One or more of the listed amino acids can be phosphorylated as set forth in the Tables
RSRSPPPVSY

SEQ ID NO: 759 - protein, 10 aa, Artificial Sequence
  Artificially synthesized peptide
  SITE (1)..(10): One or more of the listed amino acids can be phosphorylated as set forth in the Tables
RLRTSPITRK

SEQ ID NO: 760 - protein, 10 aa, Artificial Sequence
  Artificially synthesized peptide
  SITE (1)..(10): One or more of the listed amino acids can be phosphorylated as set forth in the Tables
RMRTSPITRK

SEQ ID NO: 761 - protein, 10 aa, Artificial Sequence
  Artificially synthesized peptide
  SITE (1)..(10): One or more of the listed amino acids can be phosphorylated as set forth in the Tables
RLRTSPITRR

SEQ ID NO: 762 - protein, 10 aa, Artificial Sequence
  Artificially synthesized peptide
  SITE (1)..(10): One or more of the listed amino acids can be phosphorylated as set forth in the Tables
RSRTSPITRY

SEQ ID NO: 763 - protein, 9 aa, Artificial Sequence
  Artificially synthesized peptide
  SITE (1)..(9): One or more of the listed amino acids can be phosphorylated as set forth in the Tables
RLSSLIRHK

SEQ ID NO: 764 - protein, 9 aa, Artificial Sequence
  Artificially synthesized peptide
  SITE (1)..(9): One or more of the listed amino acids can be phosphorylated as set forth in the Tables
RMSSLIRHK

SEQ ID NO: 765 - protein, 9 aa, Artificial Sequence
  Artificially synthesized peptide
  SITE (1)..(9): One or more of the listed amino acids can be phosphorylated as set forth in the Tables
RSSSLIRHY

SEQ ID NO: 766 - protein, 9 aa, Artificial Sequence
  Artificially synthesized peptide
  SITE (1)..(9): One or more of the listed amino acids can be phosphorylated as set forth in the Tables
RLVSLSMRK

SEQ ID NO: 767 - protein, 9 aa, Artificial Sequence
  Artificially synthesized peptide
  SITE (1)..(9): One or more of the listed amino acids can be phosphorylated as set forth in the Tables
RMVSLSMRK

SEQ ID NO: 768 - protein, 9 aa, Artificial Sequence
  Artificially synthesized peptide
  SITE (1)..(9): One or more of the listed amino acids can be phosphorylated as set forth in the Tables
RSVSLSMRY

SEQ ID NO: 769 - protein, 9 aa, Artificial Sequence
  Artificially synthesized peptide
  SITE (1)..(9): One or more of the listed amino acids can be phosphorylated as set forth in the Tables
RLYSGSRSK

SEQ ID NO: 770 - protein, 9 aa, Artificial Sequence
  Artificially synthesized peptide
  SITE (1)..(9): One or more of the listed amino acids can be phosphorylated as set forth in the Tables
RSYSGSRSK

SEQ ID NO: 771 - protein, 9 aa, Artificial Sequence
  Artificially synthesized peptide
  SITE (1)..(9): One or more of the listed amino acids can be phosphorylated as set forth in the Tables
RSYSGSRSY

SEQ ID NO: 772 - protein, 9 aa, Artificial Sequence
  Artificially synthesized peptide
  SITE (1)..(9): One or more of the listed amino acids can be phosphorylated as set forth in the Tables
RLYSGSRSY

SEQ ID NO: 773 - protein, 10 aa, Artificial Sequence
  Artificially synthesized peptide
  SITE (1)..(10): One or more of the listed amino acids can be phosphorylated as set forth in the Tables
RLYSPDHRQK

SEQ ID NO: 774 - protein, 10 aa, Artificial Sequence
  Artificially synthesized peptide
  SITE (1)..(10): One or more of the listed amino acids can be phosphorylated as set forth in the Tables
RMYSPDHRQK

SEQ ID NO: 775 - protein, 10 aa, Artificial Sequence
  Artificially synthesized peptide
  SITE (1)..(10): One or more of the listed amino acids can be phosphorylated as set forth in the Tables
RSYSPDHRQY

SEQ ID NO: 776 - protein, 9 aa, Artificial Sequence
  Artificially synthesized peptide
  SITE (1)..(9): One or more of the listed amino acids can be phosphorylated as set forth in the Tables
RLYSPERSK

SEQ ID NO: 777 - protein, 9 aa, Artificial Sequence
  Artificially synthesized peptide
  SITE (1)..(9): One or more of the listed amino acids can be phosphorylated as set forth in the Tables
RMYSPERSK

SEQ ID NO: 778 - protein, 9 aa, Artificial Sequence
  Artificially synthesized peptide
  SITE (1)..(9): One or more of the listed amino acids can be phosphorylated as set forth in the Tables
RSYSPERSY

SEQ ID NO: 779 - protein, 9 aa, Artificial Sequence
  Artificially synthesized peptide
  SITE (1)..(9): One or more of the listed amino acids can be phosphorylated as set forth in the Tables
RLYSPRNSK

SEQ ID NO: 780 - protein, 9 aa, Artificial Sequence
  Artificially synthesized peptide
  SITE (1)..(9): One or more of the listed amino acids can be phosphorylated as set forth in the Tables
RMYSPRNSK

SEQ ID NO: 781 - protein, 9 aa, Artificial Sequence
  Artificially synthesized peptide
  SITE (1)..(9): One or more of the listed amino acids can be phosphorylated as set forth in the Tables
RSYSPRNSY

SEQ ID NO: 782 - protein, 9 aa, Artificial Sequence
  Artificially synthesized peptide
  SITE (1)..(9): One or more of the listed amino acids can be phosphorylated as set forth in the Tables
RLYSYPRQK

SEQ ID NO: 783 - protein, 9 aa, Artificial Sequence
  Artificially synthesized peptide
  SITE (1)..(9): One or more of the listed amino acids can be phosphorylated as set forth in the Tables
RMYSYPRQK

SEQ ID NO: 784 - protein, 9 aa, Artificial Sequence
  Artificially synthesized peptide
  SITE (1)..(9): One or more of the listed amino acids can be phosphorylated as set forth in the Tables
RSYSYPRQY

SEQ ID NO: 785 - protein, 14 aa, Artificial Sequence
  Artificially synthesized peptide
  SITE (1)..(14): One or more of the listed amino acids can be phosphorylated as set forth in the Tables
RLYVTTSTRTYSLK

SEQ ID NO: 786 - protein, 14 aa, Artificial Sequence
  Artificially synthesized peptide
  SITE (1)..(14): One or more of the listed amino acids can be phosphorylated as set forth in the Tables
RMYVTTSTRTYSLK

SEQ ID NO: 787 - protein, 14 aa, Artificial Sequence
  Artificially synthesized peptide
  SITE (1)..(14): One or more of the listed amino acids can be phosphorylated as set forth in the Tables
RLYVTTSTRTYSLY

SEQ ID NO: 788 - protein, 14 aa, Artificial Sequence
  Artificially synthesized peptide
  SITE (1)..(14): One or more of the listed amino acids can be phosphorylated as set forth in the Tables
RMYVTTSTRTYSLY

SEQ ID NO: 789 - protein, 10 aa, Artificial Sequence
  Artificially synthesized peptide
  SITE (1)..(10): One or more of the listed amino acids can be phosphorylated as set forth in the Tables
RLPSFLKKNK

SEQ ID NO: 790 - protein, 10 aa, Artificial Sequence
  Artificially synthesized peptide
  SITE (1)..(10): One or more of the listed amino acids can be phosphorylated as set forth in the Tables
RMPSFLKKNK

SEQ ID NO: 791 - protein, 10 aa, Artificial Sequence
  Artificially synthesized peptide
  SITE (1)..(10): One or more of the listed amino acids can be phosphorylated as set forth in the Tables
RTPSFLKKNY

SEQ ID NO: 792 - protein, 9 aa, Artificial Sequence
  Artificially synthesized peptide
  SITE (1)..(9): One or more of the listed amino acids can be phosphorylated as set forth in the Tables
RLYKSPLRK

SEQ ID NO: 793 - protein, 9 aa, Artificial Sequence
  Artificially synthesized peptide
  SITE (1)..(9): One or more of the listed amino acids can be phosphorylated as set forth in the Tables
RMYKSPLRK

SEQ ID NO: 794 - protein, 9 aa, Artificial Sequence
  Artificially synthesized peptide
  SITE (1)..(9): One or more of the listed amino acids can be phosphorylated as set forth in the Tables
RLYKSPLRH

SEQ ID NO: 795 - protein, 9 aa, Artificial Sequence
  Artificially synthesized peptide
  SITE (1)..(9): One or more of the listed amino acids can be phosphorylated as set forth in the Tables
RMYKSPLRH

SEQ ID NO: 796 - protein, 9 aa, Artificial Sequence
  Artificially synthesized peptide
  SITE (1)..(9): One or more of the listed amino acids can be phosphorylated as set forth in the Tables
RTYKSPLRK

SEQ ID NO: 797 - protein, 9 aa, Artificial Sequence
  Artificially synthesized peptide
  SITE (1)..(9): One or more of the listed amino acids can be phosphorylated as set forth in the Tables
RTYKSPLRY

SEQ ID NO: 798 - protein, 10 aa, Artificial Sequence
  Artificially synthesized peptide
  SITE (1)..(10): One or more of the listed amino acids can be phosphorylated as set forth in the Tables
RLASPTSGVK

SEQ ID NO: 799 - protein, 10 aa, Artificial Sequence
  Artificially synthesized peptide
  SITE (1)..(10): One or more of the listed amino acids can be phosphorylated as set forth in the Tables
RMASPTSGVK

SEQ ID NO: 800 - protein, 10 aa, Artificial Sequence
  Artificially synthesized peptide
  SITE (1)..(10): One or more of the listed amino acids can be phosphorylated as set forth in the Tables
RVASPTSGVY

SEQ ID NO: 801 - protein, 11 aa, Artificial Sequence
  Artificially synthesized peptide
  SITE (1)..(11): One or more of the listed amino acids can be phosphorylated as set forth in the Tables
RLASPTSGVKK

SEQ ID NO: 802 - protein, 11 aa, Artificial Sequence
  Artificially synthesized peptide
  SITE (1)..(11): One or more of the listed amino acids can be phosphorylated as set forth in the Tables
RMASPTSGVKK

SEQ ID NO: 803 - protein, 11 aa, Artificial Sequence
  Artificially synthesized peptide
  SITE (1)..(11): One or more of the listed amino acids can be phosphorylated as set forth in the Tables
RLASPTSGVKY

SEQ ID NO: 804 - protein, 11 aa, Artificial Sequence
  Artificially synthesized peptide
  SITE (1)..(11): One or more of the listed amino acids can be phosphorylated as set forth in the Tables
RMASPTSGVKY

SEQ ID NO: 805 - protein, 11 aa, Artificial Sequence
  Artificially synthesized peptide
  SITE (1)..(11): One or more of the listed amino acids can be phosphorylated as set forth in the Tables
RVASPTSGVKK

SEQ ID NO: 806 - protein, 10 aa, Artificial Sequence
  Artificially synthesized peptide
  SITE (1)..(10): One or more of the listed amino acids can be phosphorylated as set forth in the Tables
RLKLPSGSKK

SEQ ID NO: 807 - protein, 10 aa, Artificial Sequence
  Artificially synthesized peptide
  SITE (1)..(10): One or more of the listed amino acids can be phosphorylated as set forth in the Tables
RMKLPSGSKK

SEQ ID NO: 808 - protein, 10 aa, Artificial Sequence
  Artificially synthesized peptide
  SITE (1)..(10): One or more of the listed amino acids can be phosphorylated as set forth in the Tables
RLKLPSGSKY

SEQ ID NO: 809 - protein, 10 aa, Artificial Sequence
  Artificially synthesized peptide
  SITE (1)..(10): One or more of the listed amino acids can be phosphorylated as set forth in the Tables
RMKLPSGSKY

SEQ ID NO: 810 - protein, 11 aa, Artificial Sequence
  Artificially synthesized peptide
  SITE (1)..(11): One or more of the listed amino acids can be phosphorylated as set forth in the Tables
RLKSPGSGHVK

SEQ ID NO: 811 - protein, 11 aa, Artificial Sequence
  Artificially synthesized peptide
  SITE (1)..(11): One or more of the listed amino acids can be phosphorylated as set forth in the Tables
RMKSPGSGHVK

SEQ ID NO: 812 - protein, 11 aa, Artificial Sequence
  Artificially synthesized peptide
  SITE (1)..(11): One or more of the listed amino acids can be phosphorylated as set forth in the Tables
RVKSPGSGHVY

SEQ ID NO: 813 - protein, 11 aa, Artificial Sequence
  Artificially synthesized peptide
  SITE (1)..(11): One or more of the listed amino acids can be phosphorylated as set forth in the Tables
RLKSPSPKSEK

SEQ ID NO: 814 - protein, 11 aa, Artificial Sequence
  Artificially synthesized peptide
  SITE (1)..(11): One or more of the listed amino acids can be phosphorylated as set forth in the Tables
RMKSPSPKSEK

SEQ ID NO: 815 - protein, 11 aa, Artificial Sequence
  Artificially synthesized peptide
  SITE (1)..(11): One or more of the listed amino acids can be phosphorylated as set forth in the Tables
RLKSPSPKSER

SEQ ID NO: 816 - protein, 11 aa, Artificial Sequence
  Artificially synthesized peptide
  SITE (1)..(11): One or more of the listed amino acids can be phosphorylated as set forth in the Tables
RVKSPSPKSEY

SEQ ID NO: 817 - protein, 11 aa, Artificial Sequence
  Artificially synthesized peptide
  SITE (1)..(11): One or more of the listed amino acids can be phosphorylated as set forth in the Tables
RLKTPTSQSYK

SEQ ID NO: 818 - protein, 11 aa, Artificial Sequence
  Artificially synthesized peptide
  SITE (1)..(11): One or more of the listed amino acids can be phosphorylated as set forth in the Tables
RMKTPTSQSYK

SEQ ID NO: 819 - protein, 11 aa, Artificial Sequence
  Artificially synthesized peptide
  SITE (1)..(11): One or more of the listed amino acids can be phosphorylated as set forth in the Tables
RLKTPTSQSYR

SEQ ID NO: 820 - protein, 11 aa, Artificial Sequence
  Artificially synthesized peptide
  SITE (1)..(11): One or more of the listed amino acids can be phosphorylated as set forth in the Tables
RVKTPTSQSYK

SEQ ID NO: 821 - protein, 11 aa, Artificial Sequence
  Artificially synthesized peptide
  SITE (1)..(11): One or more of the listed amino acids can be phosphorylated as set forth in the Tables
RVKTPTSQSYY

SEQ ID NO: 822 - protein, 9 aa, Artificial Sequence
  Artificially synthesized peptide
  SITE (1)..(9): One or more of the listed amino acids can be phosphorylated as set forth in the Tables
RLKTTPLRK

SEQ ID NO: 823 - protein, 9 aa, Artificial Sequence
  Artificially synthesized peptide
  SITE (1)..(9): One or more of the listed amino acids can be phosphorylated as set forth in the Tables
RMKTTPLRK

SEQ ID NO: 824 - protein, 9 aa, Artificial Sequence
  Artificially synthesized peptide
  SITE (1)..(9): One or more of the listed amino acids can be phosphorylated as set forth in the Tables
RLKTTPLRR

SEQ ID NO: 825 - protein, 9 aa, Artificial Sequence
  Artificially synthesized peptide
  SITE (1)..(9): One or more of the listed amino acids can be phosphorylated as set forth in the Tables
RVKTTPLRY

SEQ ID NO: 826 - protein, 10 aa, Artificial Sequence
  Artificially synthesized peptide
  SITE (1)..(10): One or more of the listed amino acids can be phosphorylated as set forth in the Tables
RLRQSPLATK

SEQ ID NO: 827 - protein, 10 aa, Artificial Sequence
  Artificially synthesized peptide
  SITE (1)..(10): One or more of the listed amino acids can be phosphorylated as set forth in the Tables
RMRQSPLATK

SEQ ID NO: 828 - protein, 10 aa, Artificial Sequence
  Artificially synthesized peptide
  SITE (1)..(10): One or more of the listed amino acids can be phosphorylated as set forth in the Tables
RLRQSPLATR

SEQ ID NO: 829 - protein, 10 aa, Artificial Sequence
  Artificially synthesized peptide
  SITE (1)..(10): One or more of the listed amino acids can be phosphorylated as set forth in the Tables
RVRQSPLATY

SEQ ID NO: 830 - protein, 9 aa, Artificial Sequence
  Artificially synthesized peptide
  SITE (1)..(9): One or more of the listed amino acids can be phosphorylated as set forth in the Tables
RLYSPYNHK

SEQ ID NO: 831 - protein, 9 aa, Artificial Sequence
  Artificially synthesized peptide
  SITE (1)..(9): One or more of the listed amino acids can be phosphorylated as set forth in the Tables
RVYSPYNHK

SEQ ID NO: 832 - protein, 9 aa, Artificial Sequence
  Artificially synthesized peptide
  SITE (1)..(9): One or more of the listed amino acids can be phosphorylated as set forth in the Tables
RLYSPYNHR

SEQ ID NO: 833 - protein, 9 aa, Artificial Sequence
  Artificially synthesized peptide
  SITE (1)..(9): One or more of the listed amino acids can be phosphorylated as set forth in the Tables
RVYSPYNHY

SEQ ID NO: 834 - protein, 9 aa, Artificial Sequence
  Artificially synthesized peptide
  SITE (1)..(9): One or more of the listed amino acids can be phosphorylated as set forth in the Tables
SMFSPRRNK

SEQ ID NO: 835 - protein, 9 aa, Artificial Sequence
  Artificially synthesized peptide
  SITE (1)..(9): One or more of the listed amino acids can be phosphorylated as set forth in the Tables
SLFSPRRNY

SEQ ID NO: 836 - protein, 11 aa, Artificial Sequence
  Artificially synthesized peptide
  SITE (1)..(11): One or more of the listed amino acids can be phosphorylated as set forth in the Tables
SLLNKSSPVKY

SEQ ID NO: 837 - protein, 11 aa, Artificial Sequence
  Artificially synthesized peptide
  SITE (1)..(11): One or more of the listed amino acids can be phosphorylated as set forth in the Tables
SMLNKSSPVKK

SEQ ID NO: 838 - protein, 9 aa, Artificial Sequence
  Artificially synthesized peptide
  SITE (1)..(9): One or more of the listed amino acids can be phosphorylated as set forth in the Tables
SMMSPGRRK

SEQ ID NO: 839 - protein, 9 aa, Artificial Sequence
  Artificially synthesized peptide
  SITE (1)..(9): One or more of the listed amino acids can be phosphorylated as set forth in the Tables
SLMSPGRRY

SEQ ID NO: 840 - protein, 9 aa, Artificial Sequence
  Artificially synthesized peptide
  SITE (1)..(9): One or more of the listed amino acids can be phosphorylated as set forth in the Tables
SLKSPVTVK

SEQ ID NO: 841 - protein, 9 aa, Artificial Sequence
  Artificially synthesized peptide
  SITE (1)..(9): One or more of the listed amino acids can be phosphorylated as set forth in the Tables
SMKSPVTVK

SEQ ID NO: 842 - protein, 9 aa, Artificial Sequence
  Artificially synthesized peptide
  SITE (1)..(9): One or more of the listed amino acids can be phosphorylated as set forth in the Tables
SVKSPVTVY

SEQ ID NO: 843 - protein, 9 aa, Artificial Sequence
  Artificially synthesized peptide
  SITE (1)..(9): One or more of the listed amino acids can be phosphorylated as set forth in the Tables
SLRRSVLMK

SEQ ID NO: 844 - protein, 9 aa, Artificial Sequence
  Artificially synthesized peptide
  SITE (1)..(9): One or more of the listed amino acids can be phosphorylated as set forth in the Tables
SMRRSVLMK

SEQ ID NO: 845 - protein, 9 aa, Artificial Sequence
  Artificially synthesized peptide
  SITE (1)..(9): One or more of the listed amino acids can be phosphorylated as set forth in the Tables
SVRRSVLMY

SEQ ID NO: 846 - protein, 9 aa, Artificial Sequence
  Artificially synthesized peptide
  SITE (1)..(9): One or more of the listed amino acids can be phosphorylated as set forth in the Tables
SLYSPVKKK

SEQ ID NO: 847 - protein, 9 aa, Artificial Sequence
  Artificially synthesized peptide
  SITE (1)..(9): One or more of the listed amino acids can be phosphorylated as set forth in the Tables
SMYSPVKKK

SEQ ID NO: 848 - protein, 9 aa, Artificial Sequence
  Artificially synthesized peptide
  SITE (1)..(9): One or more of the listed amino acids can be phosphorylated as set forth in the Tables
SVYSPVKKY

SEQ ID NO: 849 - protein, 9 aa, Artificial Sequence
  Artificially synthesized peptide
  SITE (1)..(9): One or more of the listed amino acids can be phosphorylated as set forth in the Tables
VMIGSPKKY

SEQ ID NO: 850 - protein, 9 aa, Artificial Sequence
  Artificially synthesized peptide
  SITE (1)..(9): One or more of the listed amino acids can be phosphorylated as set forth in the Tables
VLIGSPKKY

SEQ ID NO: 851 - protein, 12 aa, Artificial Sequence
  Artificially synthesized peptide
  SITE (1)..(12): One or more of the listed amino acids can be phosphorylated as set forth in the Tables
VLKVMIGSPKKK

SEQ ID NO: 852 - protein, 11 aa, Artificial Sequence
  Artificially synthesized peptide
  SITE (1)..(11): One or more of the listed amino acids can be phosphorylated as set forth in the Tables
VLKVMIGSPKK

SEQ ID NO: 853 - protein, 10 aa, Artificial Sequence
  Artificially synthesized peptide
  SITE (1)..(10): One or more of the listed amino acids can be phosphorylated as set forth in the Tables
VLKVMIGSPK

SEQ ID NO: 854 - protein, 12 aa, Artificial Sequence
  Artificially synthesized peptide
  SITE (1)..(12): One or more of the listed amino acids can be phosphorylated as set forth in the Tables
VMKVMIGSPKKY

SEQ ID NO: 855 - protein, 12 aa, Artificial Sequence
  Artificially synthesized peptide
  SITE (1)..(12): One or more of the listed amino acids can be phosphorylated as set forth in the Tables
VSKVMIGSPKKY

SEQ ID NO: 856 - protein, 10 aa, Artificial Sequence
  Artificially synthesized peptide
  SITE (1)..(10): One or more of the listed amino acids can be phosphorylated as set forth in the Tables
VMKVMIGSPK

SEQ ID NO: 857 - protein, 10 aa, Artificial Sequence
  Artificially synthesized peptide
  SITE (1)..(10): One or more of the listed amino acids can be phosphorylated as set forth in the Tables
VLQTPPYVKK

SEQ ID NO: 858 - protein, 10 aa, Artificial Sequence
  Artificially synthesized peptide
  SITE (1)..(10): One or more of the listed amino acids can be phosphorylated as set forth in the Tables
VMQTPPYVKK

SEQ ID NO: 859 - protein, 10 aa, Artificial Sequence
  Artificially synthesized peptide
  SITE (1)..(10): One or more of the listed amino acids can be phosphorylated as set forth in the Tables
VLQTPPYVKY

SEQ ID NO: 860 - protein, 10 aa, Artificial Sequence
  Artificially synthesized peptide
  SITE (1)..(10): One or more of the listed amino acids can be phosphorylated as set forth in the Tables
VTQTPPYVKY

SEQ ID NO: 861 - protein, 11 aa, Artificial Sequence
  Artificially synthesized peptide
  SITE (1)..(11): One or more of the listed amino acids can be phosphorylated as set forth in the Tables
AEEEIGTPRKY

SEQ ID NO: 862 - protein, 11 aa, Artificial Sequence
  Artificially synthesized peptide
  SITE (1)..(11): One or more of the listed amino acids can be phosphorylated as set forth in the Tables
AEDEIGTPRKY

SEQ ID NO: 863 - protein, 11 aa, Artificial Sequence
  Artificially synthesized peptide
  SITE (1)..(11): One or more of the listed amino acids can be phosphorylated as set forth in the Tables
AEDEIGTPRKF

SEQ ID NO: 864 - protein, 11 aa, Artificial Sequence
  Artificially synthesized peptide
  SITE (1)..(11): One or more of the listed amino acids can be phosphorylated as set forth in the Tables
ATEEIGTPRKY

SEQ ID NO: 865 - protein, 11 aa, Artificial Sequence
  Artificially synthesized peptide
  SITE (1)..(11): One or more of the listed amino acids can be phosphorylated as set forth in the Tables
ASEEIGTPRKF

SEQ ID NO: 866 - protein, 11 aa, Artificial Sequence
  Artificially synthesized peptide
  SITE (1)..(11): One or more of the listed amino acids can be phosphorylated as set forth in the Tables
ASDEIGTPRKF

SEQ ID NO: 867 - protein, 11 aa, Artificial Sequence
  Artificially synthesized peptide
  SITE (1)..(11): One or more of the listed amino acids can be phosphorylated as set forth in the Tables
ATDEIGTPRKF

SEQ ID NO: 868 - protein, 11 aa, Artificial Sequence
  Artificially synthesized peptide
  SITE (1)..(11): One or more of the listed amino acids can be phosphorylated as set forth in the Tables
ATEEIGTPRKF

SEQ ID NO: 869 - protein, 10 aa, Artificial Sequence
  Artificially synthesized peptide
  SITE (1)..(10): One or more of the listed amino acids can be phosphorylated as set forth in the Tables
DSVPLSPLKY

SEQ ID NO: 870 - protein, 10 aa, Artificial Sequence
  Artificially synthesized peptide
  SITE (1)..(10): One or more of the listed amino acids can be phosphorylated as set forth in the Tables
DTEPLSPLKY

SEQ ID NO: 871 - protein, 10 aa, Artificial Sequence
  Artificially synthesized peptide
  SITE (1)..(10): One or more of the listed amino acids can be phosphorylated as set forth in the Tables
DTDPLSPLKY

SEQ ID NO: 872 - protein, 10 aa, Artificial Sequence
  Artificially synthesized peptide
  SITE (1)..(10): One or more of the listed amino acids can be phosphorylated as set forth in the Tables
DSEPLSPLKY

SEQ ID NO: 873 - protein, 10 aa, Artificial Sequence
  Artificially synthesized peptide
  SITE (1)..(10): One or more of the listed amino acids can be phosphorylated as set forth in the Tables
DSDPLSPLKY

SEQ ID NO: 874 - protein, 8 aa, Artificial Sequence
  Artificially synthesized peptide
  SITE (1)..(8): One or more of the listed amino acids can be phosphorylated as set forth in the Tables
ESDSLPRY

SEQ ID NO: 875 - protein, 8 aa, Artificial Sequence
  Artificially synthesized peptide
  SITE (1)..(8): One or more of the listed amino acids can be phosphorylated as set forth in the Tables
ETESLPRY

SEQ ID NO: 876 - protein, 8 aa, Artificial Sequence
  Artificially synthesized peptide
  SITE (1)..(8): One or more of the listed amino acids can be phosphorylated as set forth in the Tables
ETDSLPRY

SEQ ID NO: 877 - protein, 8 aa, Artificial Sequence
  Artificially synthesized peptide
  SITE (1)..(8): One or more of the listed amino acids can be phosphorylated as set forth in the Tables
FIESPSKY

SEQ ID NO: 878 - protein, 8 aa, Artificial Sequence
  Artificially synthesized peptide
  SITE (1)..(8): One or more of the listed amino acids can be phosphorylated as set forth in the Tables
FSESPSKL

SEQ ID NO: 879 - protein, 8 aa, Artificial Sequence
  Artificially synthesized peptide
  SITE (1)..(8): One or more of the listed amino acids can be phosphorylated as set forth in the Tables
FTESPSKL

SEQ ID NO: 880 - protein, 8 aa, Artificial Sequence
  Artificially synthesized peptide
  SITE (1)..(8): One or more of the listed amino acids can be phosphorylated as set forth in the Tables
FSESPSKY

SEQ ID NO: 881 - protein, 8 aa, Artificial Sequence
  Artificially synthesized peptide
  SITE (1)..(8): One or more of the listed amino acids can be phosphorylated as set forth in the Tables
FTESPSKY

SEQ ID NO: 882 - protein, 10 aa, Artificial Sequence
  Artificially synthesized peptide
  SITE (1)..(10): One or more of the listed amino acids can be phosphorylated as set forth in the Tables
FSDSHEGFSY

SEQ ID NO: 883 - protein, 10 aa, Artificial Sequence
  Artificially synthesized peptide
  SITE (1)..(10): One or more of the listed amino acids can be phosphorylated as set forth in the Tables
FTESHEGFSY

SEQ ID NO: 884 - protein, 10 aa, Artificial Sequence
  Artificially synthesized peptide
  SITE (1)..(10): One or more of the listed amino acids can be phosphorylated as set forth in the Tables
FSESHEGFSY

SEQ ID NO: 885 - protein, 10 aa, Artificial Sequence
  Artificially synthesized peptide
  SITE (1)..(10): One or more of the listed amino acids can be phosphorylated as set forth in the Tables
FTDSHEGFSY

SEQ ID NO: 886 - protein, 10 aa, Artificial Sequence
  Artificially synthesized peptide
  SITE (1)..(10): One or more of the listed amino acids can be phosphorylated as set forth in the Tables
FTSSHEGFSY

SEQ ID NO: 887 - protein, 11 aa, Artificial Sequence
  Artificially synthesized peptide
  SITE (1)..(11): One or more of the listed amino acids can be phosphorylated as set forth in the Tables
GSESSDDGKKY

SEQ ID NO: 888 - protein, 11 aa, Artificial Sequence
  Artificially synthesized peptide
  SITE (1)..(11): One or more of the listed amino acids can be phosphorylated as set forth in the Tables
GSDSSDDGKKY

SEQ ID NO: 889 - protein, 11 aa, Artificial Sequence
  Artificially synthesized peptide
  SITE (1)..(11): One or more of the listed amino acids can be phosphorylated as set forth in the Tables
GTDSSDDGKKY

SEQ ID NO: 890 - protein, 11 aa, Artificial Sequence
  Artificially synthesized peptide
  SITE (1)..(11): One or more of the listed amino acids can be phosphorylated as set forth in the Tables
GTESSDDGKKY

SEQ ID NO: 891 - protein, 9 aa, Artificial Sequence
  Artificially synthesized peptide
  SITE (1)..(9): One or more of the listed amino acids can be phosphorylated as set forth in the Tables
IIETPHKEY

SEQ ID NO: 892 - protein, 9 aa, Artificial Sequence
  Artificially synthesized peptide
  SITE (1)..(9): One or more of the listed amino acids can be phosphorylated as set forth in the Tables
ISETPHKEI

SEQ ID NO: 893 - protein, 9 aa, Artificial Sequence
  Artificially synthesized peptide
  SITE (1)..(9): One or more of the listed amino acids can be phosphorylated as set forth in the Tables
ITETPHKEI

SEQ ID NO: 894 - protein, 9 aa, Artificial Sequence
  Artificially synthesized peptide
  SITE (1)..(9): One or more of the listed amino acids can be phosphorylated as set forth in the Tables
ISDTPHKEI

SEQ ID NO: 895 - protein, 9 aa, Artificial Sequence
  Artificially synthesized peptide
  SITE (1)..(9): One or more of the listed amino acids can be phosphorylated as set forth in the Tables
ITDTPHKEI

SEQ ID NO: 896 - protein, 9 aa, Artificial Sequence
  Artificially synthesized peptide
  SITE (1)..(9): One or more of the listed amino acids can be phosphorylated as set forth in the Tables
ISETPHKEY

SEQ ID NO: 897 - protein, 9 aa, Artificial Sequence
  Artificially synthesized peptide
  SITE (1)..(9): One or more of the listed amino acids can be phosphorylated as set forth in the Tables
ISDTPHKEY

SEQ ID NO: 898 - protein, 9 aa, Artificial Sequence
  Artificially synthesized peptide
  SITE (1)..(9): One or more of the listed amino acids can be phosphorylated as set forth in the Tables
ITDTPHKEY

SEQ ID NO: 899 - protein, 9 aa, Artificial Sequence
  Artificially synthesized peptide
  SITE (1)..(9): One or more of the listed amino acids can be phosphorylated as set forth in the Tables
ITETPHKEY

SEQ ID NO: 900 - protein, 9 aa, Artificial Sequence
  Artificially synthesized peptide
  SITE (1)..(9): One or more of the listed amino acids can be phosphorylated as set forth in the Tables
ISDSAHTDY

SEQ ID NO: 901 - protein, 9 aa, Artificial Sequence
  Artificially synthesized peptide
  SITE (1)..(9): One or more of the listed amino acids can be phosphorylated as set forth in the Tables
ISESAHTDY

SEQ ID NO: 902 - protein, 9 aa, Artificial Sequence
  Artificially synthesized peptide
  SITE (1)..(9): One or more of the listed amino acids can be phosphorylated as set forth in the Tables
ITESAHTDY

SEQ ID NO: 903 - protein, 9 aa, Artificial Sequence
  Artificially synthesized peptide
  SITE (1)..(9): One or more of the listed amino acids can be phosphorylated as set forth in the Tables
ITDSAHTDY

SEQ ID NO: 904 - protein, 9 aa, Artificial Sequence
  Artificially synthesized peptide
  SITE (1)..(9): One or more of the listed amino acids can be phosphorylated as set forth in the Tables
ISDSMHSLY

SEQ ID NO: 905 - protein, 9 aa, Artificial Sequence
  Artificially synthesized peptide
  SITE (1)..(9): One or more of the listed amino acids can be phosphorylated as set forth in the Tables
ISESMHSLY

SEQ ID NO: 906 - protein, 9 aa, Artificial Sequence
  Artificially synthesized peptide
  SITE (1)..(9): One or more of the listed amino acids can be phosphorylated as set forth in the Tables
ITESMHSLY

SEQ ID NO: 907 - protein, 9 aa, Artificial Sequence
  Artificially synthesized peptide
  SITE (1)..(9): One or more of the listed amino acids can be phosphorylated as set forth in the Tables
ITDSMHSLY

SEQ ID NO: 908 - protein, 9 aa, Artificial Sequence
  Artificially synthesized peptide
  SITE (1)..(9): One or more of the listed amino acids can be phosphorylated as set forth in the Tables
ITDGTPLKY

SEQ ID NO: 909 - protein, 9 aa, Artificial Sequence
  Artificially synthesized peptide
  SITE (1)..(9): One or more of the listed amino acids can be phosphorylated as set forth in the Tables
ITEGTPLKY

SEQ ID NO: 910 - protein, 9 aa, Artificial Sequence
  Artificially synthesized peptide
  SITE (1)..(9): One or more of the listed amino acids can be phosphorylated as set forth in the Tables
ISEGTPLKY

SEQ ID NO: 911 - protein, 9 aa, Artificial Sequence
  Artificially synthesized peptide
  SITE (1)..(9): One or more of the listed amino acids can be phosphorylated as set forth in the Tables
ISDGTPLKY

SEQ ID NO: 912 - protein, 8 aa, Artificial Sequence
  Artificially synthesized peptide
  SITE (1)..(8): One or more of the listed amino acids can be phosphorylated as set forth in the Tables
ISTDRDPL

SEQ ID NO: 913 - protein, 8 aa, Artificial Sequence
  Artificially synthesized peptide
  SITE (1)..(8): One or more of the listed amino acids can be phosphorylated as set forth in the Tables
ITTDRDPL

SEQ ID NO: 914 - protein, 8 aa, Artificial Sequence
  Artificially synthesized peptide
  SITE (1)..(8): One or more of the listed amino acids can be phosphorylated as set forth in the Tables
IVTDRDPY

SEQ ID NO: 915 - protein, 8 aa, Artificial Sequence
  Artificially synthesized peptide
  SITE (1)..(8): One or more of the listed amino acids can be phosphorylated as set forth in the Tables
ISTDRDPY

SEQ ID NO: 916 - protein, 8 aa, Artificial Sequence
  Artificially synthesized peptide
  SITE (1)..(8): One or more of the listed amino acids can be phosphorylated as set forth in the Tables
ITTDRDPY

SEQ ID NO: 917 - protein, 9 aa, Artificial Sequence
  Artificially synthesized peptide
  SITE (1)..(9): One or more of the listed amino acids can be phosphorylated as set forth in the Tables
KTDSRQERY

SEQ ID NO: 918 - protein, 9 aa, Artificial Sequence
  Artificially synthesized peptide
  SITE (1)..(9): One or more of the listed amino acids can be phosphorylated as set forth in the Tables
KSDSRQERY

SEQ ID NO: 919 - protein, 9 aa, Artificial Sequence
  Artificially synthesized peptide
  SITE (1)..(9): One or more of the listed amino acids can be phosphorylated as set forth in the Tables
KTESRQERY

SEQ ID NO: 920 - protein, 10 aa, Artificial Sequence
  Artificially synthesized peptide
  SITE (1)..(10): One or more of the listed amino acids can be phosphorylated as set forth in the Tables
LSDPSRSYSY

SEQ ID NO: 921 - protein, 10 aa, Artificial Sequence
  Artificially synthesized peptide
  SITE (1)..(10): One or more of the listed amino acids can be phosphorylated as set forth in the Tables
LSEPSRSYSY

SEQ ID NO: 922 - protein, 10 aa, Artificial Sequence
  Artificially synthesized peptide
  SITE (1)..(10): One or more of the listed amino acids can be phosphorylated as set forth in the Tables
LTEPSRSYSY

SEQ ID NO: 923 - protein, 10 aa, Artificial Sequence
  Artificially synthesized peptide
  SITE (1)..(10): One or more of the listed amino acids can be phosphorylated as set forth in the Tables
LTDPSRSYSY

SEQ ID NO: 924 - protein, 10 aa, Artificial Sequence
  Artificially synthesized peptide
  SITE (1)..(10): One or more of the listed amino acids can be phosphorylated as set forth in the Tables
LSDTPVKTQY

SEQ ID NO: 925 - protein, 10 aa, Artificial Sequence
  Artificially synthesized peptide
  SITE (1)..(10): One or more of the listed amino acids can be phosphorylated as set forth in the Tables
LSETPVKTQY

SEQ ID NO: 926 - protein, 10 aa, Artificial Sequence
  Artificially synthesized peptide
  SITE (1)..(10): One or more of the listed amino acids can be phosphorylated as set forth in the Tables
LTETPVKTQY

SEQ ID NO: 927 - protein, 10 aa, Artificial Sequence
  Artificially synthesized peptide
  SITE (1)..(10): One or more of the listed amino acids can be phosphorylated as set forth in the Tables
LTDTPVKTQY

SEQ ID NO: 928 - protein, 10 aa, Artificial Sequence
  Artificially synthesized peptide
  SITE (1)..(10): One or more of the listed amino acids can be phosphorylated as set forth in the Tables
LSESDTEAKL

SEQ ID NO: 929 - protein, 10 aa, Artificial Sequence
  Artificially synthesized peptide
  SITE (1)..(10): One or more of the listed amino acids can be phosphorylated as set forth in the Tables
LTESDTEAKL

SEQ ID NO: 930 - protein, 10 aa, Artificial Sequence
  Artificially synthesized peptide
  SITE (1)..(10): One or more of the listed amino acids can be phosphorylated as set forth in the Tables
LTDSDTEAKL

SEQ ID NO: 931 - protein, 10 aa, Artificial Sequence
  Artificially synthesized peptide
  SITE (1)..(10): One or more of the listed amino acids can be phosphorylated as set forth in the Tables
LSESDTEAKY

SEQ ID NO: 932 - protein, 10 aa, Artificial Sequence
  Artificially synthesized peptide
  SITE (1)..(10): One or more of the listed amino acids can be phosphorylated as set forth in the Tables
LSDSDTEAKY

SEQ ID NO: 933 - protein, 10 aa, Artificial Sequence
  Artificially synthesized peptide
  SITE (1)..(10): One or more of the listed amino acids can be phosphorylated as set forth in the Tables
LTDSDTEAKY

SEQ ID NO: 934 - protein, 10 aa, Artificial Sequence
  Artificially synthesized peptide
  SITE (1)..(10): One or more of the listed amino acids can be phosphorylated as set forth in the Tables
LTESDTEAKY

SEQ ID NO: 935 - protein, 9 aa, Artificial Sequence
  Artificially synthesized peptide
  SITE (1)..(9): One or more of the listed amino acids can be phosphorylated as set forth in the Tables
MSDTYRLKY

SEQ ID NO: 936 - protein, 9 aa, Artificial Sequence
  Artificially synthesized peptide
  SITE (1)..(9): One or more of the listed amino acids can be phosphorylated as set forth in the Tables
MSETYRLKY

SEQ ID NO: 937 - protein, 9 aa, Artificial Sequence
  Artificially synthesized peptide
  SITE (1)..(9): One or more of the listed amino acids can be phosphorylated as set forth in the Tables
MTETYRLKY

SEQ ID NO: 938 - protein, 8 aa, Artificial Sequence
  Artificially synthesized peptide
  SITE (1)..(8): One or more of the listed amino acids can be phosphorylated as set forth in the Tables
NSDSPLRY

SEQ ID NO: 939 - protein, 8 aa, Artificial Sequence
  Artificially synthesized peptide
  SITE (1)..(8): One or more of the listed amino acids can be phosphorylated as set forth in the Tables
NTESPLRY

SEQ ID NO: 940 - protein, 8 aa, Artificial Sequence
  Artificially synthesized peptide
  SITE (1)..(8): One or more of the listed amino acids can be phosphorylated as set forth in the Tables
NSESPLRY

SEQ ID NO: 941 - protein, 10 aa, Artificial Sequence
  Artificially synthesized peptide
  SITE (1)..(10): One or more of the listed amino acids can be phosphorylated as set forth in the Tables
QSDSPQRALY

SEQ ID NO: 942 - protein, 10 aa, Artificial Sequence
  Artificially synthesized peptide
  SITE (1)..(10): One or more of the listed amino acids can be phosphorylated as set forth in the Tables
QSESPQRALY

SEQ ID NO: 943 - protein, 10 aa, Artificial Sequence
  Artificially synthesized peptide
  SITE (1)..(10): One or more of the listed amino acids can be phosphorylated as set forth in the Tables
QTESPQRALY

SEQ ID NO: 944 - protein, 10 aa, Artificial Sequence
  Artificially synthesized peptide
  SITE (1)..(10): One or more of the listed amino acids can be phosphorylated as set forth in the Tables
QTDSPQRALY

SEQ ID NO: 945 - protein, 9 aa, Artificial Sequence
  Artificially synthesized peptide
  SITE (1)..(9): One or more of the listed amino acids can be phosphorylated as set forth in the Tables
RSDSPKIDL

SEQ ID NO: 946 - protein, 9 aa, Artificial Sequence
  Artificially synthesized peptide
  SITE (1)..(9): One or more of the listed amino acids can be phosphorylated as set forth in the Tables
RTDSPKIDL

SEQ ID NO: 947 - protein, 9 aa, Artificial Sequence
  Artificially synthesized peptide
  SITE (1)..(9): One or more of the listed amino acids can be phosphorylated as set forth in the Tables
RTESPKIDL

SEQ ID NO: 948 - protein, 9 aa, Artificial Sequence
  Artificially synthesized peptide
  SITE (1)..(9): One or more of the listed amino acids can be phosphorylated as set forth in the Tables
RSESPKIDL

SEQ ID NO: 949 - protein, 9 aa, Artificial Sequence
  Artificially synthesized peptide
  SITE (1)..(9): One or more of the listed amino acids can be phosphorylated as set forth in the Tables
RSDSPKIDY

SEQ ID NO: 950 - protein, 9 aa, Artificial Sequence
  Artificially synthesized peptide
  SITE (1)..(9): One or more of the listed amino acids can be phosphorylated as set forth in the Tables
RSESPKIDY

SEQ ID NO: 951 - protein, 9 aa, Artificial Sequence
  Artificially synthesized peptide
  SITE (1)..(9): One or more of the listed amino acids can be phosphorylated as set forth in the Tables
RTESPKIDY

SEQ ID NO: 952 - protein, 9 aa, Artificial Sequence
  Artificially synthesized peptide
  SITE (1)..(9): One or more of the listed amino acids can be phosphorylated as set forth in the Tables
RTDSPKIDY

SEQ ID NO: 953 - protein, 9 aa, Artificial Sequence
  Artificially synthesized peptide
  SITE (1)..(9): One or more of the listed amino acids can be phosphorylated as set forth in the Tables
RSESRAQAV

SEQ ID NO: 954 - protein, 9 aa, Artificial Sequence
  Artificially synthesized peptide
  SITE (1)..(9): One or more of the listed amino acids can be phosphorylated as set forth in the Tables
RTESRAQAV

SEQ ID NO: 955 - protein, 9 aa, Artificial Sequence
  Artificially synthesized peptide
  SITE (1)..(9): One or more of the listed amino acids can be phosphorylated as set forth in the Tables
RTDSRAQAV

SEQ ID NO: 956 - protein, 9 aa, Artificial Sequence
  Artificially synthesized peptide
  SITE (1)..(9): One or more of the listed amino acids can be phosphorylated as set forth in the Tables
RSESRAQAY

SEQ ID NO: 957 - protein, 9 aa, Artificial Sequence
  Artificially synthesized peptide
  SITE (1)..(9): One or more of the listed amino acids can be phosphorylated as set forth in the Tables
RSDSRAQAY

SEQ ID NO: 958 - protein, 9 aa, Artificial Sequence
  Artificially synthesized peptide
  SITE (1)..(9): One or more of the listed amino acids can be phosphorylated as set forth in the Tables
RTDSRAQAY

SEQ ID NO: 959 - protein, 9 aa, Artificial Sequence
  Artificially synthesized peptide
  SITE (1)..(9): One or more of the listed amino acids can be phosphorylated as set forth in the Tables
RTESRAQAY

SEQ ID NO: 960 - protein, 11 aa, Artificial Sequence
  Artificially synthesized peptide
  SITE (1)..(11): One or more of the listed amino acids can be phosphorylated as set forth in the Tables
RSESYVELSQY

SEQ ID NO: 961 - protein, 11 aa, Artificial Sequence
  Artificially synthesized peptide
  SITE (1)..(11): One or more of the listed amino acids can be phosphorylated as set forth in the Tables
RTESYVELSQY

SEQ ID NO: 962 - protein, 11 aa, Artificial Sequence
  Artificially synthesized peptide
  SITE (1)..(11): One or more of the listed amino acids can be phosphorylated as set forth in the Tables
RTDSYVELSQY

SEQ ID NO: 963 - protein, 9 aa, Artificial Sequence
  Artificially synthesized peptide
  SITE (1)..(9): One or more of the listed amino acids can be phosphorylated as set forth in the Tables
RSDSVGENY

SEQ ID NO: 964 - protein, 9 aa, Artificial Sequence
  Artificially synthesized peptide
  SITE (1)..(9): One or more of the listed amino acids can be phosphorylated as set forth in the Tables
RSESVGENY

SEQ ID NO: 965 - protein, 9 aa, Artificial Sequence
  Artificially synthesized peptide
  SITE (1)..(9): One or more of the listed amino acids can be phosphorylated as set forth in the Tables
RSDSVGENL

SEQ ID NO: 966 - protein, 9 aa, Artificial Sequence
  Artificially synthesized peptide
  SITE (1)..(9): One or more of the listed amino acids can be phosphorylated as set forth in the Tables
RSESVGENL

SEQ ID NO: 967 - protein, 13 aa, Artificial Sequence
  Artificially synthesized peptide
  SITE (1)..(13): One or more of the listed amino acids can be phosphorylated as set forth in the Tables
RSDPSKSPGSLRY

SEQ ID NO: 968 - protein, 13 aa, Artificial Sequence
  Artificially synthesized peptide
  SITE (1)..(13): One or more of the listed amino acids can be phosphorylated as set forth in the Tables
RTDPSKSPGSLRY

SEQ ID NO: 969 - protein, 13 aa, Artificial Sequence
  Artificially synthesized peptide
  SITE (1)..(13): One or more of the listed amino acids can be phosphorylated as set forth in the Tables
RSEPSKSPGSLRY

SEQ ID NO: 970 - protein, 8 aa, Artificial Sequence
  Artificially synthesized peptide
  SITE (1)..(8): One or more of the listed amino acids can be phosphorylated as set forth in the Tables
SSDSPQKL

SEQ ID NO: 971 - protein, 8 aa, Artificial Sequence
  Artificially synthesized peptide
  SITE (1)..(8): One or more of the listed amino acids can be phosphorylated as set forth in the Tables
SSESPQKL

SEQ ID NO: 972 - protein, 8 aa, Artificial Sequence
  Artificially synthesized peptide
  SITE (1)..(8): One or more of the listed amino acids can be phosphorylated as set forth in the Tables
SSESPQKY

SEQ ID NO: 973 - protein, 8 aa, Artificial Sequence
  Artificially synthesized peptide
  SITE (1)..(8): One or more of the listed amino acids can be phosphorylated as set forth in the Tables
SSDSPQKY

SEQ ID NO: 974 - protein, 8 aa, Artificial Sequence
  Artificially synthesized peptide
  SITE (1)..(8): One or more of the listed amino acids can be phosphorylated as set forth in the Tables
STESPQKY

SEQ ID NO: 975 - protein, 8 aa, Artificial Sequence
  Artificially synthesized peptide
  SITE (1)..(8): One or more of the listed amino acids can be phosphorylated as set forth in the Tables
STDSPQKY

SEQ ID NO: 976 - protein, 8 aa, Artificial Sequence
  Artificially synthesized peptide
  SITE (1)..(8): One or more of the listed amino acids can be phosphorylated as set forth in the Tables
SIDSPQKY

SEQ ID NO: 977 - protein, 10 aa, Artificial Sequence
  Artificially synthesized peptide
  SITE (1)..(10): One or more of the listed amino acids can be phosphorylated as set forth in the Tables
SSDSPSYVLY

SEQ ID NO: 978 - protein, 10 aa, Artificial Sequence
  Artificially synthesized peptide
  SITE (1)..(10): One or more of the listed amino acids can be phosphorylated as set forth in the Tables
SSESPSYVLY

SEQ ID NO: 979 - protein, 10 aa, Artificial Sequence
  Artificially synthesized peptide
  SITE (1)..(10): One or more of the listed amino acids can be phosphorylated as set forth in the Tables
STESPSYVLY

SEQ ID NO: 980 - protein, 10 aa, Artificial Sequence
  Artificially synthesized peptide
  SITE (1)..(10): One or more of the listed amino acids can be phosphorylated as set forth in the Tables
STDSPSYVLY

SEQ ID NO: 981 - protein, 10 aa, Artificial Sequence
  Artificially synthesized peptide
  SITE (1)..(10): One or more of the listed amino acids can be phosphorylated as set forth in the Tables
SLESPSYVLY

SEQ ID NO: 982 - protein, 8 aa, Artificial Sequence
  Artificially synthesized peptide
  SITE (1)..(8): One or more of the listed amino acids can be phosphorylated as set forth in the Tables
SSDKHSEY

SEQ ID NO: 983 - protein, 8 aa, Artificial Sequence
  Artificially synthesized peptide
  SITE (1)..(8): One or more of the listed amino acids can be phosphorylated as set forth in the Tables
SSEKHSEY

SEQ ID NO: 984 - protein, 8 aa, Artificial Sequence
  Artificially synthesized peptide
  SITE (1)..(8): One or more of the listed amino acids can be phosphorylated as set forth in the Tables
STEKHSEY

SEQ ID NO: 985 - protein, 8 aa, Artificial Sequence
  Artificially synthesized peptide
  SITE (1)..(8): One or more of the listed amino acids can be phosphorylated as set forth in the Tables
STDKHSEY

SEQ ID NO: 986 - protein, 8 aa, Artificial Sequence
  Artificially synthesized peptide
  SITE (1)..(8): One or more of the listed amino acids can be phosphorylated as set forth in the Tables
SRDKHSEY

SEQ ID NO: 987 - protein, 10 aa, Artificial Sequence
  Artificially synthesized peptide
  SITE (1)..(10): One or more of the listed amino acids can be phosphorylated as set forth in the Tables
STDPASQLSY

SEQ ID NO: 988 - protein, 10 aa, Artificial Sequence
  Artificially synthesized peptide
  SITE (1)..(10): One or more of the listed amino acids can be phosphorylated as set forth in the Tables
SSEPASQLSY

SEQ ID NO: 989 - protein, 10 aa, Artificial Sequence
  Artificially synthesized peptide
  SITE (1)..(10): One or more of the listed amino acids can be phosphorylated as set forth in the Tables
STEPASQLSY

SEQ ID NO: 990 - protein, 10 aa, Artificial Sequence
  Artificially synthesized peptide
  SITE (1)..(10): One or more of the listed amino acids can be phosphorylated as set forth in the Tables
SSESPTNHFY

SEQ ID NO: 991 - protein, 10 aa, Artificial Sequence
  Artificially synthesized peptide
  SITE (1)..(10): One or more of the listed amino acids can be phosphorylated as set forth in the Tables
STDSPTNHFY

SEQ ID NO: 992 - protein, 10 aa, Artificial Sequence
  Artificially synthesized peptide
  SITE (1)..(10): One or more of the listed amino acids can be phosphorylated as set forth in the Tables
STESPTNHFY

SEQ ID NO: 993 - protein, 9 aa, Artificial Sequence
  Artificially synthesized peptide
  SITE (1)..(9): One or more of the listed amino acids can be phosphorylated as set forth in the Tables
SSDSETLRY

SEQ ID NO: 994 - protein, 9 aa, Artificial Sequence
  Artificially synthesized peptide
  SITE (1)..(9): One or more of the listed amino acids can be phosphorylated as set forth in the Tables
STESETLRY

SEQ ID NO: 995 - protein, 9 aa, Artificial Sequence
  Artificially synthesized peptide
  SITE (1)..(9): One or more of the listed amino acids can be phosphorylated as set forth in the Tables
SSESETLRY

SEQ ID NO: 996 - protein, 9 aa, Artificial Sequence
  Artificially synthesized peptide
  SITE (1)..(9): One or more of the listed amino acids can be phosphorylated as set forth in the Tables
SSDISPTRL

SEQ ID NO: 997 - protein, 9 aa, Artificial Sequence
  Artificially synthesized peptide
  SITE (1)..(9): One or more of the listed amino acids can be phosphorylated as set forth in the Tables
STDISPTRL

SEQ ID NO: 998 - protein, 9 aa, Artificial Sequence
  Artificially synthesized peptide
  SITE (1)..(9): One or more of the listed amino acids can be phosphorylated as set forth in the Tables
STEISPTRL

SEQ ID NO: 999 - protein, 9 aa, Artificial Sequence
  Artificially synthesized peptide
  SITE (1)..(9): One or more of the listed amino acids can be phosphorylated as set forth in the Tables
STEISPTRL

SEQ ID NO: 1000 - protein, 9 aa, Artificial Sequence
  Artificially synthesized peptide
  SITE (1)..(9): One or more of the listed amino acids can be phosphorylated as set forth in the Tables
SVDISPTRY

SEQ ID NO: 1001 - protein, 9 aa, Artificial Sequence
  Artificially synthesized peptide
  SITE (1)..(9): One or more of the listed amino acids can be phosphorylated as set forth in the Tables
SSDISPTRY

SEQ ID NO: 1002 - protein, 9 aa, Artificial Sequence
  Artificially synthesized peptide
  SITE (1)..(9): One or more of the listed amino acids can be phosphorylated as set forth in the Tables
SSEISPTRY

SEQ ID NO: 1003 - protein, 9 aa, Artificial Sequence
  Artificially synthesized peptide
  SITE (1)..(9): One or more of the listed amino acids can be phosphorylated as set forth in the Tables
STDISPTRY

SEQ ID NO: 1004 - protein, 9 aa, Artificial Sequence
  Artificially synthesized peptide
  SITE (1)..(9): One or more of the listed amino acids can be phosphorylated as set forth in the Tables
STEISPTRY

SEQ ID NO: 1005 - protein, 10 aa, Artificial Sequence
  Artificially synthesized peptide
  SITE (1)..(10): One or more of the listed amino acids can be phosphorylated as set forth in the Tables
TMESPGKDNY

SEQ ID NO: 1006 - protein, 10 aa, Artificial Sequence
  Artificially synthesized peptide
  SITE (1)..(10): One or more of the listed amino acids can be phosphorylated as set forth in the Tables
TMDSPGKDNY

SEQ ID NO: 1007 - protein, 10 aa, Artificial Sequence
  Artificially synthesized peptide
  SITE (1)..(10): One or more of the listed amino acids can be phosphorylated as set forth in the Tables
TSDSPGKDNY

SEQ ID NO: 1008 - protein, 10 aa, Artificial Sequence
  Artificially synthesized peptide
  SITE (1)..(10): One or more of the listed amino acids can be phosphorylated as set forth in the Tables
TSESPGKDNY

SEQ ID NO: 1009 - protein, 10 aa, Artificial Sequence
  Artificially synthesized peptide
  SITE (1)..(10): One or more of the listed amino acids can be phosphorylated as set forth in the Tables
TTASPGKDNY

SEQ ID NO: 1010 - protein, 10 aa, Artificial Sequence
  Artificially synthesized peptide
  SITE (1)..(10): One or more of the listed amino acids can be phosphorylated as set forth in the Tables
TSASPGKDNY

SEQ ID NO: 1011 - protein, 10 aa, Artificial Sequence
  Artificially synthesized peptide
  SITE (1)..(10): One or more of the listed amino acids can be phosphorylated as set forth in the Tables
TTDSPGKDNY

SEQ ID NO: 1012 - protein, 10 aa, Artificial Sequence
  Artificially synthesized peptide
  SITE (1)..(10): One or more of the listed amino acids can be phosphorylated as set forth in the Tables
TTESPGKDNY

SEQ ID NO: 1013 - protein, 11 aa, Artificial Sequence
  Artificially synthesized peptide
  SITE (1)..(11): One or more of the listed amino acids can be phosphorylated as set forth in the Tables
TSDTPDYLLKY

SEQ ID NO: 1014 - protein, 11 aa, Artificial Sequence
  Artificially synthesized peptide
  SITE (1)..(11): One or more of the listed amino acids can be phosphorylated as set forth in the Tables
TTDTPDYLLKY

SEQ ID NO: 1015 - protein, 11 aa, Artificial Sequence
  Artificially synthesized peptide
  SITE (1)..(11): One or more of the listed amino acids can be phosphorylated as set forth in the Tables
TTETPDYLLKY

SEQ ID NO: 1016 - protein, 11 aa, Artificial Sequence
  Artificially synthesized peptide
  SITE (1)..(11): One or more of the listed amino acids can be phosphorylated as set forth in the Tables
AEEEIGTPRKY

SEQ ID NO: 1017 - protein, 11 aa, Artificial Sequence
  Artificially synthesized peptide
  SITE (1)..(11): One or more of the listed amino acids can be phosphorylated as set forth in the Tables
AEEEIGTPRKW

SEQ ID NO: 1018 - protein, 10 aa, Artificial Sequence
  Artificially synthesized peptide
  SITE (1)..(10): One or more of the listed amino acids can be phosphorylated as set forth in the Tables
AENSPTRQQY

SEQ ID NO: 1019 - protein, 10 aa, Artificial Sequence
  Artificially synthesized peptide
  SITE (1)..(10): One or more of the listed amino acids can be phosphorylated as set forth in the Tables
AENSPTRQQW

SEQ ID NO: 1020 - protein, 11 aa, Artificial Sequence
  Artificially synthesized peptide
  SITE (1)..(11): One or more of the listed amino acids can be phosphorylated as set forth in the Tables
AESSPTAGKKF

SEQ ID NO: 1021 - protein, 11 aa, Artificial Sequence
  Artificially synthesized peptide
  SITE (1)..(11): One or more of the listed amino acids can be phosphorylated as set forth in the Tables
AESSPTAGKKY

SEQ ID NO: 1022 - protein, 11 aa, Artificial Sequence
  Artificially synthesized peptide
  SITE (1)..(11): One or more of the listed amino acids can be phosphorylated as set forth in the Tables
AESSPTAGKKW

SEQ ID NO: 1023 - protein, 9 aa, Artificial Sequence
  Artificially synthesized peptide
  SITE (1)..(9): One or more of the listed amino acids can be phosphorylated as set forth in the Tables
ATAGPRLGF

SEQ ID NO: 1024 - protein, 9 aa, Artificial Sequence
  Artificially synthesized peptide
  SITE (1)..(9): One or more of the listed amino acids can be phosphorylated as set forth in the Tables
ATAGPRLGY

SEQ ID NO: 1025 - protein, 9 aa, Artificial Sequence
  Artificially synthesized peptide
  SITE (1)..(9): One or more of the listed amino acids can be phosphorylated as set forth in the Tables
DERLRINSF

SEQ ID NO: 1026 - protein, 9 aa, Artificial Sequence
  Artificially synthesized peptide
  SITE (1)..(9): One or more of the listed amino acids can be phosphorylated as set forth in the Tables
DERLRINSY

SEQ ID NO: 1027 - protein, 9 aa, Artificial Sequence
  Artificially synthesized peptide
  SITE (1)..(9): One or more of the listed amino acids can be phosphorylated as set forth in the Tables
DERLRINSW

SEQ ID NO: 1028 - protein, 9 aa, Artificial Sequence
  Artificially synthesized peptide
  SITE (1)..(9): One or more of the listed amino acids can be phosphorylated as set forth in the Tables
DEFERIKTF

SEQ ID NO: 1029 - protein, 9 aa, Artificial Sequence
  Artificially synthesized peptide
  SITE (1)..(9): One or more of the listed amino acids can be phosphorylated as set forth in the Tables
DEFERIKTY

SEQ ID NO: 1030 - protein, 9 aa, Artificial Sequence
  Artificially synthesized peptide
  SITE (1)..(9): One or more of the listed amino acids can be phosphorylated as set forth in the Tables
DEFERIKTW

SEQ ID NO: 1031 - protein, 9 aa, Artificial Sequence
  Artificially synthesized peptide
  SITE (1)..(9): One or more of the listed amino acids can be phosphorylated as set forth in the Tables
DEISHRASF

SEQ ID NO: 1032 - protein, 9 aa, Artificial Sequence
  Artificially synthesized peptide
  SITE (1)..(9): One or more of the listed amino acids can be phosphorylated as set forth in the Tables
DEISHRASY

SEQ ID NO: 1033 - protein, 9 aa, Artificial Sequence
  Artificially synthesized peptide
  SITE (1)..(9): One or more of the listed amino acids can be phosphorylated as set forth in the Tables
DEISHRASW

SEQ ID NO: 1034 - protein, 10 aa, Artificial Sequence
  Artificially synthesized peptide
  SITE (1)..(10): One or more of the listed amino acids can be phosphorylated as set forth in the Tables
EESSDDGKKF

SEQ ID NO: 1035 - protein, 10 aa, Artificial Sequence
  Artificially synthesized peptide
  SITE (1)..(10): One or more of the listed amino acids can be phosphorylated as set forth in the Tables
EESSDDGKKW

SEQ ID NO: 1036 - protein, 10 aa, Artificial Sequence
  Artificially synthesized peptide
  SITE (1)..(10): One or more of the listed amino acids can be phosphorylated as set forth in the Tables
EESSDDGKKF

SEQ ID NO: 1037 - protein, 10 aa, Artificial Sequence
  Artificially synthesized peptide
  SITE (1)..(10): One or more of the listed amino acids can be phosphorylated as set forth in the Tables
EESSDDGKKW

SEQ ID NO: 1038 - protein, 11 aa, Artificial Sequence
  Artificially synthesized peptide
  SITE (1)..(11): One or more of the listed amino acids can be phosphorylated as set forth in the Tables
GEESSDDGKKF

SEQ ID NO: 1039 - protein, 11 aa, Artificial Sequence
  Artificially synthesized peptide
  SITE (1)..(10): One or more of the listed amino acids can be phosphorylated as set forth in the Tables
GEESSDDGKKW

SEQ ID NO: 1040 - protein, 9 aa, Artificial Sequence
  Artificially synthesized peptide
  SITE (1)..(9): One or more of the listed amino acids can be phosphorylated as set forth in the Tables
KEMSPTRQF

SEQ ID NO: 1041 - protein, 9 aa, Artificial Sequence
  Artificially synthesized peptide
  SITE (1)..(9): One or more of the listed amino acids can be phosphorylated as set forth in the Tables
KEMSPTRQY

SEQ ID NO: 1042 - protein, 9 aa, Artificial Sequence
  Artificially synthesized peptide
  SITE (1)..(9): One or more of the listed amino acids can be phosphorylated as set forth in the Tables
KEMSPTRQW

SEQ ID NO: 1043 - protein, 9 aa, Artificial Sequence
  Artificially synthesized peptide
  SITE (1)..(9): One or more of the listed amino acids can be phosphorylated as set forth in the Tables
REKSPLFQF

SEQ ID NO: 1044 - protein, 9 aa, Artificial Sequence
  Artificially synthesized peptide
  SITE (1)..(9): One or more of the listed amino acids can be phosphorylated as set forth in the Tables
REKSPLFQY

SEQ ID NO: 1045 - protein, 9 aa, Artificial Sequence
  Artificially synthesized peptide
  SITE (1)..(9): One or more of the listed amino acids can be phosphorylated as set forth in the Tables
REKSPLFQW

SEQ ID NO: 1046 - protein, 9 aa, Artificial Sequence
  Artificially synthesized peptide
  SITE (1)..(9): One or more of the listed amino acids can be phosphorylated as set forth in the Tables
SEGSLHRKF

SEQ ID NO: 1047 - protein, 9 aa, Artificial Sequence
  Artificially synthesized peptide
  SITE (1)..(9): One or more of the listed amino acids can be phosphorylated as set forth in the Tables
SEGSLHRKW

SEQ ID NO: 1048 - protein, 11 aa, Artificial Sequence
  Artificially synthesized peptide
  SITE (1)..(11): One or more of the listed amino acids can be phosphorylated as set forth in the Tables
ARFSPDDKYSF

SEQ ID NO: 1049 - protein, 11 aa, Artificial Sequence
  Artificially synthesized peptide
  SITE (1)..(11): One or more of the listed amino acids can be phosphorylated as set forth in the Tables
ARFSPDDKYSK

SEQ ID NO: 1050 - protein, 11 aa, Artificial Sequence
  Artificially synthesized peptide
  SITE (1)..(11): One or more of the listed amino acids can be phosphorylated as set forth in the Tables
ARFSPDDKYSY

SEQ ID NO: 1051 - protein, 9 aa, Artificial Sequence
  Artificially synthesized peptide
  SITE (1)..(9): One or more of the listed amino acids can be phosphorylated as set forth in the Tables
FRYSGKTEF

SEQ ID NO: 1052 - protein, 9 aa, Artificial Sequence
  Artificially synthesized peptide
  SITE (1)..(9): One or more of the listed amino acids can be phosphorylated as set forth in the Tables
FRYSGKTER

SEQ ID NO: 1053 - protein, 9 aa, Artificial Sequence
  Artificially synthesized peptide
  SITE (1)..(9): One or more of the listed amino acids can be phosphorylated as set forth in the Tables
FRYSGKTEK

SEQ ID NO: 1054 - protein, 9 aa, Artificial Sequence
  Artificially synthesized peptide
  SITE (1)..(9): One or more of the listed amino acids can be phosphorylated as set forth in the Tables
GRKSPPPSK

SEQ ID NO: 1055 - protein, 9 aa, Artificial Sequence
  Artificially synthesized peptide
  SITE (1)..(9): One or more of the listed amino acids can be phosphorylated as set forth in the Tables
GRKSPPPSY

SEQ ID NO: 1056 - protein, 9 aa, Artificial Sequence
  Artificially synthesized peptide
  SITE (1)..(9): One or more of the listed amino acids can be phosphorylated as set forth in the Tables
GRKSPPPSR

SEQ ID NO: 1057 - protein, 9 aa, Artificial Sequence
  Artificially synthesized peptide
  SITE (1)..(9): One or more of the listed amino acids can be phosphorylated as set forth in the Tables
GRLGSPHRF

SEQ ID NO: 1058 - protein, 9 aa, Artificial Sequence
  Artificially synthesized peptide
  SITE (1)..(9): One or more of the listed amino acids can be phosphorylated as set forth in the Tables
GRLGSPHRY

SEQ ID NO: 1059 - protein, 9 aa, Artificial Sequence
  Artificially synthesized peptide
  SITE (1)..(9): One or more of the listed amino acids can be phosphorylated as set forth in the Tables
GRLGSPHRK

SEQ ID NO: 1060 - protein, 11 aa, Artificial Sequence
  Artificially synthesized peptide
  SITE (1)..(11): One or more of the listed amino acids can be phosphorylated as set forth in the Tables
GRLSPKASQVY

SEQ ID NO: 1061 - protein, 11 aa, Artificial Sequence
  Artificially synthesized peptide
  SITE (1)..(11): One or more of the listed amino acids can be phosphorylated as set forth in the Tables
GRLSPKASQVF

SEQ ID NO: 1062 - protein, 11 aa, Artificial Sequence
  Artificially synthesized peptide
  SITE (1)..(11): One or more of the listed amino acids can be phosphorylated as set forth in the Tables
GRLSPKASQVR

SEQ ID NO: 1063 - protein, 10 aa, Artificial Sequence
  Artificially synthesized peptide
  SITE (1)..(10): One or more of the listed amino acids can be phosphorylated as set forth in the Tables
GRLSPVPVPY

SEQ ID NO: 1064 - protein, 10 aa, Artificial Sequence
  Artificially synthesized peptide
  SITE (1)..(10): One or more of the listed amino acids can be phosphorylated as set forth in the Tables
GRLSPVPVPF

SEQ ID NO: 1065 - protein, 10 aa, Artificial Sequence
  Artificially synthesized peptide
  SITE (1)..(10): One or more of the listed amino acids can be phosphorylated as set forth in the Tables
GRLSPVPVPK

SEQ ID NO: 1066 - protein, 11 aa, Artificial Sequence
  Artificially synthesized peptide
  SITE (1)..(11): One or more of the listed amino acids can be phosphorylated as set forth in the Tables
GRSSTASLVKY

SEQ ID NO: 1067 - protein, 11 aa, Artificial Sequence
  Artificially synthesized peptide
  SITE (1)..(11): One or more of the listed amino acids can be phosphorylated as set forth in the Tables
GRSSTASLVKF

SEQ ID NO: 1068 - protein, 12 aa, Artificial Sequence
  Artificially synthesized peptide
  SITE (1)..(12): One or more of the listed amino acids can be phosphorylated as set forth in the Tables
GRSSTASLVKKK

SEQ ID NO: 1069 - protein, 10 aa, Artificial Sequence
  Artificially synthesized peptide
  SITE (1)..(10): One or more of the listed amino acids can be phosphorylated as set forth in the Tables
HRLSPVKGEY

SEQ ID NO: 1070 - protein, 10 aa, Artificial Sequence
  Artificially synthesized peptide
  SITE (1)..(10): One or more of the listed amino acids can be phosphorylated as set forth in the Tables
HRLSPVKGEK

SEQ ID NO: 1071 - protein, 10 aa, Artificial Sequence
  Artificially synthesized peptide
  SITE (1)..(10): One or more of the listed amino acids can be phosphorylated as set forth in the Tables
HRLSPVKGER

SEQ ID NO: 1072 - protein, 11 aa, Artificial Sequence
  Artificially synthesized peptide
  SITE (1)..(11): One or more of the listed amino acids can be phosphorylated as set forth in the Tables
HRNSNPVIAEF

SEQ ID NO: 1073 - protein, 11 aa, Artificial Sequence
  Artificially synthesized peptide
  SITE (1)..(11): One or more of the listed amino acids can be phosphorylated as set forth in the Tables
HRNSNPVIAEY

SEQ ID NO: 1074 - protein, 11 aa, Artificial Sequence
  Artificially synthesized peptide
  SITE (1)..(11): One or more of the listed amino acids can be phosphorylated as set forth in the Tables
HRNSNPVIAEK

SEQ ID NO: 1075 - protein, 11 aa, Artificial Sequence
  Artificially synthesized peptide
  SITE (1)..(11): One or more of the listed amino acids can be phosphorylated as set forth in the Tables
HRNSNPVIAER

SEQ ID NO: 1076 - protein, 10 aa, Artificial Sequence
  Artificially synthesized peptide
  SITE (1)..(10): One or more of the listed amino acids can be phosphorylated as set forth in the Tables
KRASGQAFEK

SEQ ID NO: 1077 - protein, 10 aa, Artificial Sequence
  Artificially synthesized peptide
  SITE (1)..(10): One or more of the listed amino acids can be phosphorylated as set forth in the Tables
KRASGQAFEF

SEQ ID NO: 1078 - protein, 10 aa, Artificial Sequence
  Artificially synthesized peptide
  SITE (1)..(10): One or more of the listed amino acids can be phosphorylated as set forth in the Tables
KRASGQAFEY

SEQ ID NO: 1079 - protein, 10 aa, Artificial Sequence
  Artificially synthesized peptide
  SITE (1)..(10): One or more of the listed amino acids can be phosphorylated as set forth in the Tables
KRASGQAFER

SEQ ID NO: 1080 - protein, 9 aa, Artificial Sequence
  Artificially synthesized peptide
  SITE (1)..(9): One or more of the listed amino acids can be phosphorylated as set forth in the Tables
KRASFAKSL

SEQ ID NO: 1081 - protein, 9 aa, Artificial Sequence
  Artificially synthesized peptide
  SITE (1)..(9): One or more of the listed amino acids can be phosphorylated as set forth in the Tables
KRASFAKSF

SEQ ID NO: 1082 - protein, 9 aa, Artificial Sequence
  Artificially synthesized peptide
  SITE (1)..(9): One or more of the listed amino acids can be phosphorylated as set forth in the Tables
KRASFAKSY

SEQ ID NO: 1083 - protein, 9 aa, Artificial Sequence
  Artificially synthesized peptide
  SITE (1)..(9): One or more of the listed amino acids can be phosphorylated as set forth in the Tables
KRASFAKSK

SEQ ID NO: 1084 - protein, 9 aa, Artificial Sequence
  Artificially synthesized peptide
  SITE (1)..(9): One or more of the listed amino acids can be phosphorylated as set forth in the Tables
KRASFAKSR

SEQ ID NO: 1085 - protein, 9 aa, Artificial Sequence
  Artificially synthesized peptide
  SITE (1)..(9): One or more of the listed amino acids can be phosphorylated as set forth in the Tables
KRASSPFRL

SEQ ID NO: 1086 - protein, 9 aa, Artificial Sequence
  Artificially synthesized peptide
  SITE (1)..(9): One or more of the listed amino acids can be phosphorylated as set forth in the Tables
KRASSPFRF

SEQ ID NO: 1087 - protein, 9 aa, Artificial Sequence
  Artificially synthesized peptide
  SITE (1)..(9): One or more of the listed amino acids can be phosphorylated as set forth in the Tables
KRASSPFRY

SEQ ID NO: 1088 - protein, 9 aa, Artificial Sequence
  Artificially synthesized peptide
  SITE (1)..(9): One or more of the listed amino acids can be phosphorylated as set forth in the Tables
KRASSPFRK

SEQ ID NO: 1089 - protein, 9 aa, Artificial Sequence
  Artificially synthesized peptide
  SITE (1)..(9): One or more of the listed amino acids can be phosphorylated as set forth in the Tables
KRASVFVKF

SEQ ID NO: 1090 - protein, 9 aa, Artificial Sequence
  Artificially synthesized peptide
  SITE (1)..(9): One or more of the listed amino acids can be phosphorylated as set forth in the Tables
KRASVFVKY

SEQ ID NO: 1091 - protein, 9 aa, Artificial Sequence
  Artificially synthesized peptide
  SITE (1)..(9): One or more of the listed amino acids can be phosphorylated as set forth in the Tables
KRASVFVKK

SEQ ID NO: 1092 - protein, 9 aa, Artificial Sequence
  Artificially synthesized peptide
  SITE (1)..(9): One or more of the listed amino acids can be phosphorylated as set forth in the Tables
KRASVFVKR

SEQ ID NO: 1093 - protein, 7 aa, Artificial Sequence
  Artificially synthesized peptide
  SITE (1)..(7): One or more of the listed amino acids can be phosphorylated as set forth in the Tables
KRFSFKR

SEQ ID NO: 1094 - protein, 7 aa, Artificial Sequence
  Artificially synthesized peptide
  SITE (1)..(7): One or more of the listed amino acids can be phosphorylated as set forth in the Tables
KRFSFKF

SEQ ID NO: 1095 - protein, 7 aa, Artificial Sequence
  Artificially synthesized peptide
  SITE (1)..(7): One or more of the listed amino acids can be phosphorylated as set forth in the Tables
KRFSFKY

SEQ ID NO: 1096 - protein, 7 aa, Artificial Sequence
  Artificially synthesized peptide
  SITE (1)..(7): One or more of the listed amino acids can be phosphorylated as set forth in the Tables
KRFSFKL

SEQ ID NO: 1097 - protein, 9 aa, Artificial Sequence
  Artificially synthesized peptide
  SITE (1)..(9): One or more of the listed amino acids can be phosphorylated as set forth in the Tables
KRFSFKKSL

SEQ ID NO: 1098 - protein, 9 aa, Artificial Sequence
  Artificially synthesized peptide
  SITE (1)..(9): One or more of the listed amino acids can be phosphorylated as set forth in the Tables
KRFSFKKSY

SEQ ID NO: 1099 - protein, 9 aa, Artificial Sequence
  Artificially synthesized peptide
  SITE (1)..(9): One or more of the listed amino acids can be phosphorylated as set forth in the Tables
KRFSFKKSK

SEQ ID NO: 1100 - protein, 9 aa, Artificial Sequence
  Artificially synthesized peptide
  SITE (1)..(9): One or more of the listed amino acids can be phosphorylated as set forth in the Tables
KRFSFKKSR

SEQ ID NO: 1101 - protein, 9 aa, Artificial Sequence
  Artificially synthesized peptide
  SITE (1)..(9): One or more of the listed amino acids can be phosphorylated as set forth in the Tables
KRFSGTVRF

SEQ ID NO: 1102 - protein, 9 aa, Artificial Sequence
  Artificially synthesized peptide
  SITE (1)..(9): One or more of the listed amino acids can be phosphorylated as set forth in the Tables
KRFSGTVRY

SEQ ID NO: 1103 - protein, 9 aa, Artificial Sequence
  Artificially synthesized peptide
  SITE (1)..(9): One or more of the listed amino acids can be phosphorylated as set forth in the Tables
KRFSGTVRK

SEQ ID NO: 1104 - protein, 9 aa, Artificial Sequence
  Artificially synthesized peptide
  SITE (1)..(9): One or more of the listed amino acids can be phosphorylated as set forth in the Tables
KRFSGTVRR

SEQ ID NO: 1105 - protein, 9 aa, Artificial Sequence
  Artificially synthesized peptide
  SITE (1)..(9): One or more of the listed amino acids can be phosphorylated as set forth in the Tables
KRLSPAPQF

SEQ ID NO: 1106 - protein, 9 aa, Artificial Sequence
  Artificially synthesized peptide
  SITE (1)..(9): One or more of the listed amino acids can be phosphorylated as set forth in the Tables
KRLSPAPQY

SEQ ID NO: 1107 - protein, 9 aa, Artificial Sequence
  Artificially synthesized peptide
  SITE (1)..(9): One or more of the listed amino acids can be phosphorylated as set forth in the Tables
KRLSPAPQK

SEQ ID NO: 1108 - protein, 9 aa, Artificial Sequence
  Artificially synthesized peptide
  SITE (1)..(9): One or more of the listed amino acids can be phosphorylated as set forth in the Tables
KRLSPAPQR

SEQ ID NO: 1109 - protein, 9 aa, Artificial Sequence
  Artificially synthesized peptide
  SITE (1)..(9): One or more of the listed amino acids can be phosphorylated as set forth in the Tables
KRLSVERIK

SEQ ID NO: 1110 - protein, 9 aa, Artificial Sequence
  Artificially synthesized peptide
  SITE (1)..(9): One or more of the listed amino acids can be phosphorylated as set forth in the Tables
KRLSVERIF

SEQ ID NO: 1111 - protein, 9 aa, Artificial Sequence
  Artificially synthesized peptide
  SITE (1)..(109: One or more of the listed amino acids can be phosphorylated as set forth in the Tables
KRLSVERIR

SEQ ID NO: 1112 - protein, 8 aa, Artificial Sequence
  Artificially synthesized peptide
  SITE (1)..(8): One or more of the listed amino acids can be phosphorylated as set forth in the Tables
KRMSPKPF

SEQ ID NO: 1113 - protein, 8 aa, Artificial Sequence
  Artificially synthesized peptide
  SITE (1)..(180): One or more of the listed amino acids can be phosphorylated as set forth in the Tables
KRMSPKPY

SEQ ID NO: 1114 - protein, 8 aa, Artificial Sequence
  Artificially synthesized peptide
  SITE (1)..(8): One or more of the listed amino acids can be phosphorylated as set forth in the Tables
KRMSPKPK

SEQ ID NO: 1115 - protein, 8 aa, Artificial Sequence
  Artificially synthesized peptide
  SITE (1)..(8): One or more of the listed amino acids can be phosphorylated as set forth in the Tables
KRMSPKPR

SEQ ID NO: 1116 - protein, 9 aa, Artificial Sequence
  Artificially synthesized peptide
  SITE (1)..(9): One or more of the listed amino acids can be phosphorylated as set forth in the Tables
KRYSGNMEK

SEQ ID NO: 1117 - protein, 9 aa, Artificial Sequence
  Artificially synthesized peptide
  SITE (1)..(9): One or more of the listed amino acids can be phosphorylated as set forth in the Tables
KRYSGNMEF

SEQ ID NO: 1118 - protein, 9 aa, Artificial Sequence
  Artificially synthesized peptide
  SITE (1)..(9): One or more of the listed amino acids can be phosphorylated as set forth in the Tables
KRYSGNMEM

SEQ ID NO: 1119 - protein, 9 aa, Artificial Sequence
  Artificially synthesized peptide
  SITE (1)..(9): One or more of the listed amino acids can be phosphorylated as set forth in the Tables
MRLSRELQF

SEQ ID NO: 1120 - protein, 9 aa, Artificial Sequence
  Artificially synthesized peptide
  SITE (1)..(9): One or more of the listed amino acids can be phosphorylated as set forth in the Tables
MRLSRELQY

SEQ ID NO: 1121 - protein, 9 aa, Artificial Sequence
  Artificially synthesized peptide
  SITE (1)..(9): One or more of the listed amino acids can be phosphorylated as set forth in the Tables
MRLSRELQR

SEQ ID NO: 1122 - protein, 10 aa, Artificial Sequence
  Artificially synthesized peptide
  SITE (1)..(10): One or more of the listed amino acids can be phosphorylated as set forth in the Tables
NRYTNRVVTF

SEQ ID NO: 1123 - protein, 10 aa, Artificial Sequence
  Artificially synthesized peptide
  SITE (1)..(10): One or more of the listed amino acids can be phosphorylated as set forth in the Tables
NRYTNRVVTY

SEQ ID NO: 1124 - protein, 10 aa, Artificial Sequence
  Artificially synthesized peptide
  SITE (1)..(10): One or more of the listed amino acids can be phosphorylated as set forth in the Tables
NRYTNRVVTK

SEQ ID NO: 1125 - protein, 10 aa, Artificial Sequence
  Artificially synthesized peptide
  SITE (1)..(10): One or more of the listed amino acids can be phosphorylated as set forth in the Tables
NRYTNRVVTR

SEQ ID NO: 1126 - protein, 9 aa, Artificial Sequence
  Artificially synthesized peptide
  SITE (1)..(9): One or more of the listed amino acids can be phosphorylated as set forth in the Tables
RRFSPPRRK

SEQ ID NO: 1127 - protein, 9 aa, Artificial Sequence
  Artificially synthesized peptide
  SITE (1)..(9): One or more of the listed amino acids can be phosphorylated as set forth in the Tables
RRFSPPRRF

SEQ ID NO: 1128 - protein, 9 aa, Artificial Sequence
  Artificially synthesized peptide
  SITE (1)..(9): One or more of the listed amino acids can be phosphorylated as set forth in the Tables
RRFSPPRRY

SEQ ID NO: 1129 - protein, 9 aa, Artificial Sequence
  Artificially synthesized peptide
  SITE (1)..(9): One or more of the listed amino acids can be phosphorylated as set forth in the Tables
RRFSPPRRR

SEQ ID NO: 1130 - protein, 9 aa, Artificial Sequence
  Artificially synthesized peptide
  SITE (1)..(9): One or more of the listed amino acids can be phosphorylated as set forth in the Tables
RRFSRSPIK

SEQ ID NO: 1131 - protein, 9 aa, Artificial Sequence
  Artificially synthesized peptide
  SITE (1)..(9): One or more of the listed amino acids can be phosphorylated as set forth in the Tables
RRFSRSPIF

SEQ ID NO: 1132 - protein, 9 aa, Artificial Sequence
  Artificially synthesized peptide
  SITE (1)..(9): One or more of the listed amino acids can be phosphorylated as set forth in the Tables
RRFSRSPIY

SEQ ID NO: 1133 - protein, 9 aa, Artificial Sequence
  Artificially synthesized peptide
  SITE (1)..(9): One or more of the listed amino acids can be phosphorylated as set forth in the Tables
RRFSRSPIL

SEQ ID NO: 1134 - protein, 9 aa, Artificial Sequence
  Artificially synthesized peptide
  SITE (1)..(9): One or more of the listed amino acids can be phosphorylated as set forth in the Tables
RRFSRSPIL

SEQ ID NO: 1135 - protein, 9 aa, Artificial Sequence
  Artificially synthesized peptide
  SITE (1)..(9): One or more of the listed amino acids can be phosphorylated as set forth in the Tables
RRFSRSPIF

SEQ ID NO: 1136 - protein, 9 aa, Artificial Sequence
  Artificially synthesized peptide
  SITE (1)..(9): One or more of the listed amino acids can be phosphorylated as set forth in the Tables
RRFSRSPIY

SEQ ID NO: 1137 - protein, 9 aa, Artificial Sequence
  Artificially synthesized peptide
  SITE (1)..(9): One or more of the listed amino acids can be phosphorylated as set forth in the Tables
RRFSRSPIK

SEQ ID NO: 1138 - protein, 10 aa, Artificial Sequence
  Artificially synthesized peptide
  SITE (1)..(10): One or more of the listed amino acids can be phosphorylated as set forth in the Tables
RRFSRSPIRK

SEQ ID NO: 1139 - protein, 10 aa, Artificial Sequence
  Artificially synthesized peptide
  SITE (1)..(10): One or more of the listed amino acids can be phosphorylated as set forth in the Tables
RRFSRSPIRF

SEQ ID NO: 1140 - protein, 10 aa, Artificial Sequence
  Artificially synthesized peptide
  SITE (1)..(10): One or more of the listed amino acids can be phosphorylated as set forth in the Tables
RRFSRSPIRY

SEQ ID NO: 1141 - protein, 10 aa, Artificial Sequence
  Artificially synthesized peptide
  SITE (1)..(10): One or more of the listed amino acids can be phosphorylated as set forth in the Tables
RRFSRSPIRL

SEQ ID NO: 1142 - protein, 10 aa, Artificial Sequence
  Artificially synthesized peptide
  SITE (1)..(10): One or more of the listed amino acids can be phosphorylated as set forth in the Tables
RRFSRSPIRL

SEQ ID NO: 1143 - protein, 10 aa, Artificial Sequence
  Artificially synthesized peptide
  SITE (1)..(10): One or more of the listed amino acids can be phosphorylated as set forth in the Tables
RRFSRSPIRF

SEQ ID NO: 1144 - protein, 10 aa, Artificial Sequence
  Artificially synthesized peptide
  SITE (1)..(10): One or more of the listed amino acids can be phosphorylated as set forth in the Tables
RRFSRSPIRY

SEQ ID NO: 1145 - protein, 10 aa, Artificial Sequence
  Artificially synthesized peptide
  SITE (1)..(10): One or more of the listed amino acids can be phosphorylated as set forth in the Tables
RRFSRSPIRK

SEQ ID NO: 1146 - protein, 9 aa, Artificial Sequence
  Artificially synthesized peptide
  SITE (1)..(9): One or more of the listed amino acids can be phosphorylated as set forth in the Tables
RRISGVDRK

SEQ ID NO: 1147 - protein, 9 aa, Artificial Sequence
  Artificially synthesized peptide
  SITE (1)..(9): One or more of the listed amino acids can be phosphorylated as set forth in the Tables
RRISGVDRF

SEQ ID NO: 1148 - protein, 9 aa, Artificial Sequence
  Artificially synthesized peptide
  SITE (1)..(9): One or more of the listed amino acids can be phosphorylated as set forth in the Tables
RRISGVDRR

SEQ ID NO: 1149 - protein, 10 aa, Artificial Sequence
  Artificially synthesized peptide
  SITE (1)..(10): One or more of the listed amino acids can be phosphorylated as set forth in the Tables
RRISGVDRYL

SEQ ID NO: 1150 - protein, 10 aa, Artificial Sequence
  Artificially synthesized peptide
  SITE (1)..(10): One or more of the listed amino acids can be phosphorylated as set forth in the Tables
RRISGVDRYF

SEQ ID NO: 1151 - protein, 10 aa, Artificial Sequence
  Artificially synthesized peptide
  SITE (1)..(10): One or more of the listed amino acids can be phosphorylated as set forth in the Tables
RRISGVDRYK

SEQ ID NO: 1152 - protein, 10 aa, Artificial Sequence
  Artificially synthesized peptide
  SITE (1)..(10): One or more of the listed amino acids can be phosphorylated as set forth in the Tables
RRISGVDRYR

SEQ ID NO: 1153 - protein, 9 aa, Artificial Sequence
  Artificially synthesized peptide
  SITE (1)..(9): One or more of the listed amino acids can be phosphorylated as set forth in the Tables
RRKSQLDSF

SEQ ID NO: 1154 - protein, 9 aa, Artificial Sequence
  Artificially synthesized peptide
  SITE (1)..(9): One or more of the listed amino acids can be phosphorylated as set forth in the Tables
RRKSQLDSY

SEQ ID NO: 1155 - protein, 9 aa, Artificial Sequence
  Artificially synthesized peptide
  SITE (1)..(9): One or more of the listed amino acids can be phosphorylated as set forth in the Tables
RRKSQLDSK

SEQ ID NO: 1156 - protein, 9 aa, Artificial Sequence
  Artificially synthesized peptide
  SITE (1)..(9): One or more of the listed amino acids can be phosphorylated as set forth in the Tables
RRKSQLDSR

SEQ ID NO: 1157 - protein, 9 aa, Artificial Sequence
  Artificially synthesized peptide
  SITE (1)..(9): One or more of the listed amino acids can be phosphorylated as set forth in the Tables
RRKSQVAEF

SEQ ID NO: 1158 - protein, 9 aa, Artificial Sequence
  Artificially synthesized peptide
  SITE (1)..(9): One or more of the listed amino acids can be phosphorylated as set forth in the Tables
RRKSQVAEY

SEQ ID NO: 1159 - protein, 9 aa, Artificial Sequence
  Artificially synthesized peptide
  SITE (1)..(9): One or more of the listed amino acids can be phosphorylated as set forth in the Tables
RRKSQVAEK

SEQ ID NO: 1160 - protein, 9 aa, Artificial Sequence
  Artificially synthesized peptide
  SITE (1)..(9): One or more of the listed amino acids can be phosphorylated as set forth in the Tables
RRKSQVAER

SEQ ID NO: 1161 - protein, 9 aa, Artificial Sequence
  Artificially synthesized peptide
  SITE (1)..(9): One or more of the listed amino acids can be phosphorylated as set forth in the Tables
RRLSADIRF

SEQ ID NO: 1162 - protein, 9 aa, Artificial Sequence
  Artificially synthesized peptide
  SITE (1)..(9): One or more of the listed amino acids can be phosphorylated as set forth in the Tables
RRLSADIRY

SEQ ID NO: 1163 - protein, 9 aa, Artificial Sequence
  Artificially synthesized peptide
  SITE (1)..(9): One or more of the listed amino acids can be phosphorylated as set forth in the Tables
RRLSADIRK

SEQ ID NO: 1164 - protein, 9 aa, Artificial Sequence
  Artificially synthesized peptide
  SITE (1)..(9): One or more of the listed amino acids can be phosphorylated as set forth in the Tables
RRLSADIRR

SEQ ID NO: 1165 - protein, 9 aa, Artificial Sequence
  Artificially synthesized peptide
  SITE (1)..(9): One or more of the listed amino acids can be phosphorylated as set forth in the Tables
RRLSFLVSL

SEQ ID NO: 1166 - protein, 9 aa, Artificial Sequence
  Artificially synthesized peptide
  SITE (1)..(9): One or more of the listed amino acids can be phosphorylated as set forth in the Tables
RRLSFLVSF

SEQ ID NO: 1167 - protein, 9 aa, Artificial Sequence
  Artificially synthesized peptide
  SITE (1)..(9): One or more of the listed amino acids can be phosphorylated as set forth in the Tables
RRLSFLVSK

SEQ ID NO: 1168 - protein, 9 aa, Artificial Sequence
  Artificially synthesized peptide
  SITE (1)..(9): One or more of the listed amino acids can be phosphorylated as set forth in the Tables
RRLSFLVSR

SEQ ID NO: 1169 - protein, 10 aa, Artificial Sequence
  Artificially synthesized peptide
  SITE (1)..(10): One or more of the listed amino acids can be phosphorylated as set forth in the Tables
RRLSGGSHSL

SEQ ID NO: 1170 - protein, 10 aa, Artificial Sequence
  Artificially synthesized peptide
  SITE (1)..(10): One or more of the listed amino acids can be phosphorylated as set forth in the Tables
RRLSGGSHSF

SEQ ID NO: 1171 - protein, 10 aa, Artificial Sequence
  Artificially synthesized peptide
  SITE (1)..(10): One or more of the listed amino acids can be phosphorylated as set forth in the Tables
RRLSGGSHSM

SEQ ID NO: 1172 - protein, 10 aa, Artificial Sequence
  Artificially synthesized peptide
  SITE (1)..(10): One or more of the listed amino acids can be phosphorylated as set forth in the Tables
RRLSGPLHTF

SEQ ID NO: 1173 - protein, 10 aa, Artificial Sequence
  Artificially synthesized peptide
  SITE (1)..(10): One or more of the listed amino acids can be phosphorylated as set forth in the Tables
RRLSGPLHTY

SEQ ID NO: 1174 - protein, 10 aa, Artificial Sequence
  Artificially synthesized peptide
  SITE (1)..(10): One or more of the listed amino acids can be phosphorylated as set forth in the Tables
RRLSGPLHTM

SEQ ID NO: 1175 - protein, 9 aa, Artificial Sequence
  Artificially synthesized peptide
  SITE (1)..(9): One or more of the listed amino acids can be phosphorylated as set forth in the Tables
RRMSLLSVL

SEQ ID NO: 1176 - protein, 9 aa, Artificial Sequence
  Artificially synthesized peptide
  SITE (1)..(9): One or more of the listed amino acids can be phosphorylated as set forth in the Tables
RRMSLLSVF

SEQ ID NO: 1177 - protein, 9 aa, Artificial Sequence
  Artificially synthesized peptide
  SITE (1)..(9): One or more of the listed amino acids can be phosphorylated as set forth in the Tables
RRMSLLSVY

SEQ ID NO: 1178 - protein, 9 aa, Artificial Sequence
  Artificially synthesized peptide
  SITE (1)..(9): One or more of the listed amino acids can be phosphorylated as set forth in the Tables
RRMSLLSVM

SEQ ID NO: 1179 - protein, 9 aa, Artificial Sequence
  Artificially synthesized peptide
  SITE (1)..(9): One or more of the listed amino acids can be phosphorylated as set forth in the Tables
RRNSSERTF

SEQ ID NO: 1180 - protein, 9 aa, Artificial Sequence
  Artificially synthesized peptide
  SITE (1)..(9): One or more of the listed amino acids can be phosphorylated as set forth in the Tables
RRNSSERTY

SEQ ID NO: 1181 - protein, 9 aa, Artificial Sequence
  Artificially synthesized peptide
  SITE (1)..(9): One or more of the listed amino acids can be phosphorylated as set forth in the Tables
RRNSSERTM

SEQ ID NO: 1182 - protein, 9 aa, Artificial Sequence
  Artificially synthesized peptide
  SITE (1)..(9): One or more of the listed amino acids can be phosphorylated as set forth in the Tables
RRNSSIVGL

SEQ ID NO: 1183 - protein, 9 aa, Artificial Sequence
  Artificially synthesized peptide
  SITE (1)..(9): One or more of the listed amino acids can be phosphorylated as set forth in the Tables
RRNSSIVGF

SEQ ID NO: 1184 - protein, 9 aa, Artificial Sequence
  Artificially synthesized peptide
  SITE (1)..(9): One or more of the listed amino acids can be phosphorylated as set forth in the Tables
RRNSSIVGY

SEQ ID NO: 1185 - protein, 9 aa, Artificial Sequence
  Artificially synthesized peptide
  SITE (1)..(9): One or more of the listed amino acids can be phosphorylated as set forth in the Tables
RRNSSIVGK

SEQ ID NO: 1186 - protein, 9 aa, Artificial Sequence
  Artificially synthesized peptide
  SITE (1)..(9): One or more of the listed amino acids can be phosphorylated as set forth in the Tables
RRNSSIVGR

SEQ ID NO: 1187 - protein, 10 aa, Artificial Sequence
  Artificially synthesized peptide
  SITE (1)..(10): One or more of the listed amino acids can be phosphorylated as set forth in the Tables
RRNSVFQQGK

SEQ ID NO: 1188 - protein, 10 aa, Artificial Sequence
  Artificially synthesized peptide
  SITE (1)..(10): One or more of the listed amino acids can be phosphorylated as set forth in the Tables
RRNSVFQQGF

SEQ ID NO: 1189 - protein, 10 aa, Artificial Sequence
  Artificially synthesized peptide
  SITE (1)..(10): One or more of the listed amino acids can be phosphorylated as set forth in the Tables
RRNSVFQQGY

SEQ ID NO: 1190 - protein, 10 aa, Artificial Sequence
  Artificially synthesized peptide
  SITE (1)..(10): One or more of the listed amino acids can be phosphorylated as set forth in the Tables
RRNSVFQQGR

SEQ ID NO: 1191 - protein, 9 aa, Artificial Sequence
  Artificially synthesized peptide
  SITE (1)..(9): One or more of the listed amino acids can be phosphorylated as set forth in the Tables
RRPSLVHGK

SEQ ID NO: 1192 - protein, 9 aa, Artificial Sequence
  Artificially synthesized peptide
  SITE (1)..(9): One or more of the listed amino acids can be phosphorylated as set forth in the Tables
RRPSLVHGF

SEQ ID NO: 1193 - protein, 9 aa, Artificial Sequence
  Artificially synthesized peptide
  SITE (1)..(9): One or more of the listed amino acids can be phosphorylated as set forth in the Tables
RRPSLVHGR

SEQ ID NO: 1194 - protein, 9 aa, Artificial Sequence
  Artificially synthesized peptide
  SITE (1)..(9): One or more of the listed amino acids can be phosphorylated as set forth in the Tables
RRPSVFERF

SEQ ID NO: 1195 - protein, 9 aa, Artificial Sequence
  Artificially synthesized peptide
  SITE (1)..(9): One or more of the listed amino acids can be phosphorylated as set forth in the Tables
RRPSVFERY

SEQ ID NO: 1196 - protein, 9 aa, Artificial Sequence
  Artificially synthesized peptide
  SITE (1)..(9): One or more of the listed amino acids can be phosphorylated as set forth in the Tables
RRPSVFERK

SEQ ID NO: 1197 - protein, 9 aa, Artificial Sequence
  Artificially synthesized peptide
  SITE (1)..(9): One or more of the listed amino acids can be phosphorylated as set forth in the Tables
RRPSVFERR

SEQ ID NO: 1198 - protein, 9 aa, Artificial Sequence
  Artificially synthesized peptide
  SITE (1)..(9): One or more of the listed amino acids can be phosphorylated as set forth in the Tables
RRPSYRKIF

SEQ ID NO: 1199 - protein, 9 aa, Artificial Sequence
  Artificially synthesized peptide
  SITE (1)..(9): One or more of the listed amino acids can be phosphorylated as set forth in the Tables
RRPSYRKIY

SEQ ID NO: 1200 - protein, 9 aa, Artificial Sequence
  Artificially synthesized peptide
  SITE (1)..(9): One or more of the listed amino acids can be phosphorylated as set forth in the Tables
RRPSYRKIK

SEQ ID NO: 1201 - protein, 9 aa, Artificial Sequence
  Artificially synthesized peptide
  SITE (1)..(9): One or more of the listed amino acids can be phosphorylated as set forth in the Tables
RRPSYRKIR

SEQ ID NO: 1202 - protein, 9 aa, Artificial Sequence
  Artificially synthesized peptide
  SITE (1)..(9): One or more of the listed amino acids can be phosphorylated as set forth in the Tables
RRPSYTLGL

SEQ ID NO: 1203 - protein, 9 aa, Artificial Sequence
  Artificially synthesized peptide
  SITE (1)..(9): One or more of the listed amino acids can be phosphorylated as set forth in the Tables
RRPSYTLGF

SEQ ID NO: 1204 - protein, 9 aa, Artificial Sequence
  Artificially synthesized peptide
  SITE (1)..(9): One or more of the listed amino acids can be phosphorylated as set forth in the Tables
RRPSYTLGY

SEQ ID NO: 1205 - protein, 9 aa, Artificial Sequence
  Artificially synthesized peptide
  SITE (1)..(9): One or more of the listed amino acids can be phosphorylated as set forth in the Tables
RRPSYTLGR

SEQ ID NO: 1206 - protein, 9 aa, Artificial Sequence
  Artificially synthesized peptide
  SITE (1)..(9): One or more of the listed amino acids can be phosphorylated as set forth in the Tables
RRPSYTLGK

SEQ ID NO: 1207 - protein, 9 aa, Artificial Sequence
  Artificially synthesized peptide
  SITE (1)..(9): One or more of the listed amino acids can be phosphorylated as set forth in the Tables
RRSSFLQVL

SEQ ID NO: 1208 - protein, 9 aa, Artificial Sequence
  Artificially synthesized peptide
  SITE (1)..(9): One or more of the listed amino acids can be phosphorylated as set forth in the Tables
RRSSFLQVY

SEQ ID NO: 1209 - protein, 9 aa, Artificial Sequence
  Artificially synthesized peptide
  SITE (1)..(9): One or more of the listed amino acids can be phosphorylated as set forth in the Tables
RRSSFLQVM

SEQ ID NO: 1210 - protein, 9 aa, Artificial Sequence
  Artificially synthesized peptide
  SITE (1)..(9): One or more of the listed amino acids can be phosphorylated as set forth in the Tables
RRSSIGLRL

SEQ ID NO: 1211 - protein, 9 aa, Artificial Sequence
  Artificially synthesized peptide
  SITE (1)..(9): One or more of the listed amino acids can be phosphorylated as set forth in the Tables
RRSSIGLRF

SEQ ID NO: 1212 - protein, 9 aa, Artificial Sequence
  Artificially synthesized peptide
  SITE (1)..(9): One or more of the listed amino acids can be phosphorylated as set forth in the Tables
RRSSIGLRY

SEQ ID NO: 1213 - protein, 9 aa, Artificial Sequence
  Artificially synthesized peptide
  SITE (1)..(9): One or more of the listed amino acids can be phosphorylated as set forth in the Tables
RRSSIGLRK

SEQ ID NO: 1214 - protein, 9 aa, Artificial Sequence
  Artificially synthesized peptide
  SITE (1)..(9): One or more of the listed amino acids can be phosphorylated as set forth in the Tables
RRSSIGLRR

SEQ ID NO: 1215 - protein, 9 aa, Artificial Sequence
  Artificially synthesized peptide
  SITE (1)..(9): One or more of the listed amino acids can be phosphorylated as set forth in the Tables
RRSSIQSTL

SEQ ID NO: 1216 - protein, 9 aa, Artificial Sequence
  Artificially synthesized peptide
  SITE (1)..(9): One or more of the listed amino acids can be phosphorylated as set forth in the Tables
RRSSIQSTY

SEQ ID NO: 1217 - protein, 9 aa, Artificial Sequence
  Artificially synthesized peptide
  SITE (1)..(9): One or more of the listed amino acids can be phosphorylated as set forth in the Tables
RRSSIQSTK

SEQ ID NO: 1218 - protein, 9 aa, Artificial Sequence
  Artificially synthesized peptide
  SITE (1)..(9): One or more of the listed amino acids can be phosphorylated as set forth in the Tables
RRSSIQSTR

SEQ ID NO: 1219 - protein, 9 aa, Artificial Sequence
  Artificially synthesized peptide
  SITE (1)..(9): One or more of the listed amino acids can be phosphorylated as set forth in the Tables
RRSSQSWSF

SEQ ID NO: 1220 - protein, 9 aa, Artificial Sequence
  Artificially synthesized peptide
  SITE (1)..(9): One or more of the listed amino acids can be phosphorylated as set forth in the Tables
RRSSQSWSY

SEQ ID NO: 1221 - protein, 9 aa, Artificial Sequence
  Artificially synthesized peptide
  SITE (1)..(9): One or more of the listed amino acids can be phosphorylated as set forth in the Tables
RRSSQSWSK

SEQ ID NO: 1222 - protein, 9 aa, Artificial Sequence
  Artificially synthesized peptide
  SITE (1)..(9): One or more of the listed amino acids can be phosphorylated as set forth in the Tables
RRSSQSWSR

SEQ ID NO: 1223 - protein, 9 aa, Artificial Sequence
  Artificially synthesized peptide
  SITE (1)..(9): One or more of the listed amino acids can be phosphorylated as set forth in the Tables
RRSSVDLGF

SEQ ID NO: 1224 - protein, 9 aa, Artificial Sequence
  Artificially synthesized peptide
  SITE (1)..(9): One or more of the listed amino acids can be phosphorylated as set forth in the Tables
RRSSVDLGY

SEQ ID NO: 1225 - protein, 9 aa, Artificial Sequence
  Artificially synthesized peptide
  SITE (1)..(9): One or more of the listed amino acids can be phosphorylated as set forth in the Tables
RRSSVDLGK

SEQ ID NO: 1226 - protein, 9 aa, Artificial Sequence
  Artificially synthesized peptide
  SITE (1)..(9): One or more of the listed amino acids can be phosphorylated as set forth in the Tables
RRSSVDLGR

SEQ ID NO: 1227 - protein, 9 aa, Artificial Sequence
  Artificially synthesized peptide
  SITE (1)..(9): One or more of the listed amino acids can be phosphorylated as set forth in the Tables
RRSSVDLGF

SEQ ID NO: 1228 - protein, 9 aa, Artificial Sequence
  Artificially synthesized peptide
  SITE (1)..(9): One or more of the listed amino acids can be phosphorylated as set forth in the Tables
RRSSVDLGY

SEQ ID NO: 1229 - protein, 9 aa, Artificial Sequence
  Artificially synthesized peptide
  SITE (1)..(9): One or more of the listed amino acids can be phosphorylated as set forth in the Tables
RRSSVDLGK

SEQ ID NO: 1230 - protein, 9 aa, Artificial Sequence
  Artificially synthesized peptide
  SITE (1)..(9): One or more of the listed amino acids can be phosphorylated as set forth in the Tables
RRSSVDLGR

SEQ ID NO: 1231 - protein, 9 aa, Artificial Sequence
  Artificially synthesized peptide
  SITE (1)..(9): One or more of the listed amino acids can be phosphorylated as set forth in the Tables
RRSSVKVEL

SEQ ID NO: 1232 - protein, 9 aa, Artificial Sequence
  Artificially synthesized peptide
  SITE (1)..(9): One or more of the listed amino acids can be phosphorylated as set forth in the Tables
RRSSVKVEF

SEQ ID NO: 1233 - protein, 9 aa, Artificial Sequence
  Artificially synthesized peptide
  SITE (1)..(9): One or more of the listed amino acids can be phosphorylated as set forth in the Tables
RRSSVKVEY

SEQ ID NO: 1234 - protein, 9 aa, Artificial Sequence
  Artificially synthesized peptide
  SITE (1)..(9): One or more of the listed amino acids can be phosphorylated as set forth in the Tables
RRSSVKVEK

SEQ ID NO: 1235 - protein, 9 aa, Artificial Sequence
  Artificially synthesized peptide
  SITE (1)..(9): One or more of the listed amino acids can be phosphorylated as set forth in the Tables
RRSSVKVER

SEQ ID NO: 1236 - protein, 9 aa, Artificial Sequence
  Artificially synthesized peptide
  SITE (1)..(9): One or more of the listed amino acids can be phosphorylated as set forth in the Tables
RRVVQRSSF

SEQ ID NO: 1237 - protein, 9 aa, Artificial Sequence
  Artificially synthesized peptide
  SITE (1)..(9): One or more of the listed amino acids can be phosphorylated as set forth in the Tables
RRVVQRSSY

SEQ ID NO: 1238 - protein, 9 aa, Artificial Sequence
  Artificially synthesized peptide
  SITE (1)..(9): One or more of the listed amino acids can be phosphorylated as set forth in the Tables
RRVVQRSSK

SEQ ID NO: 1239 - protein, 9 aa, Artificial Sequence
  Artificially synthesized peptide
  SITE (1)..(9): One or more of the listed amino acids can be phosphorylated as set forth in the Tables
RRVVQRSSR

SEQ ID NO: 1240 - protein, 9 aa, Artificial Sequence
  Artificially synthesized peptide
  SITE (1)..(9): One or more of the listed amino acids can be phosphorylated as set forth in the Tables
RRYSPPIQF

SEQ ID NO: 1241 - protein, 9 aa, Artificial Sequence
  Artificially synthesized peptide
  SITE (1)..(9): One or more of the listed amino acids can be phosphorylated as set forth in the Tables
RRYSPPIQK

SEQ ID NO: 1242 - protein, 9 aa, Artificial Sequence
  Artificially synthesized peptide
  SITE (1)..(9): One or more of the listed amino acids can be phosphorylated as set forth in the Tables
RRYSPPIQY

SEQ ID NO: 1243 - protein, 9 aa, Artificial Sequence
  Artificially synthesized peptide
  SITE (1)..(9): One or more of the listed amino acids can be phosphorylated as set forth in the Tables
RRYSPPIQR

SEQ ID NO: 1244 - protein, 8 aa, Artificial Sequence
  Artificially synthesized peptide
  SITE (1)..(8): One or more of the listed amino acids can be phosphorylated as set forth in the Tables
SRLTHLSF

SEQ ID NO: 1245 - protein, 8 aa, Artificial Sequence
  Artificially synthesized peptide
  SITE (1)..(8): One or more of the listed amino acids can be phosphorylated as set forth in the Tables
SRLTHLSY

SEQ ID NO: 1246 - protein, 8 aa, Artificial Sequence
  Artificially synthesized peptide
  SITE (1)..(8): One or more of the listed amino acids can be phosphorylated as set forth in the Tables
SRLTHLSK

SEQ ID NO: 1247 - protein, 8 aa, Artificial Sequence
  Artificially synthesized peptide
  SITE (1)..(8): One or more of the listed amino acids can be phosphorylated as set forth in the Tables
SRLTHLSR

SEQ ID NO: 1248 - protein, 9 aa, Artificial Sequence
  Artificially synthesized peptide
  SITE (1)..(9): One or more of the listed amino acids can be phosphorylated as set forth in the Tables
SRMSPKAQL

SEQ ID NO: 1249 - protein, 9 aa, Artificial Sequence
  Artificially synthesized peptide
  SITE (1)..(9): One or more of the listed amino acids can be phosphorylated as set forth in the Tables
SRMSPKAQF

SEQ ID NO: 1250 - protein, 9 aa, Artificial Sequence
  Artificially synthesized peptide
  SITE (1)..(9): One or more of the listed amino acids can be phosphorylated as set forth in the Tables
SRMSPKAQY

SEQ ID NO: 1251 - protein, 9 aa, Artificial Sequence
  Artificially synthesized peptide
  SITE (1)..(9): One or more of the listed amino acids can be phosphorylated as set forth in the Tables
SRMSPKAQK

SEQ ID NO: 1252 - protein, 9 aa, Artificial Sequence
  Artificially synthesized peptide
  SITE (1)..(9): One or more of the listed amino acids can be phosphorylated as set forth in the Tables
SRTSPITRR

SEQ ID NO: 1253 - protein, 9 aa, Artificial Sequence
  Artificially synthesized peptide
  SITE (1)..(9): One or more of the listed amino acids can be phosphorylated as set forth in the Tables
SRTSPITRL

SEQ ID NO: 1254 - protein, 9 aa, Artificial Sequence
  Artificially synthesized peptide
  SITE (1)..(9): One or more of the listed amino acids can be phosphorylated as set forth in the Tables
SRTSPITRF

SEQ ID NO: 1255 - protein, 9 aa, Artificial Sequence
  Artificially synthesized peptide
  SITE (1)..(9): One or more of the listed amino acids can be phosphorylated as set forth in the Tables
SRTSPITRY

SEQ ID NO: 1256 - protein, 9 aa, Artificial Sequence
  Artificially synthesized peptide
  SITE (1)..(9): One or more of the listed amino acids can be phosphorylated as set forth in the Tables
SRTSPITRK

SEQ ID NO: 1257 - protein, 10 aa, Artificial Sequence
  Artificially synthesized peptide
  SITE (1)..(10): One or more of the listed amino acids can be phosphorylated as set forth in the Tables
SRYSRSPYSL

SEQ ID NO: 1258 - protein, 10 aa, Artificial Sequence
  Artificially synthesized peptide
  SITE (1)..(10): One or more of the listed amino acids can be phosphorylated as set forth in the Tables
SRYSRSPYSF

SEQ ID NO: 1259 - protein, 10 aa, Artificial Sequence
  Artificially synthesized peptide
  SITE (1)..(10): One or more of the listed amino acids can be phosphorylated as set forth in the Tables
SRYSRSPYSY

SEQ ID NO: 1260 - protein, 10 aa, Artificial Sequence
  Artificially synthesized peptide
  SITE (1)..(10): One or more of the listed amino acids can be phosphorylated as set forth in the Tables
SRYSRSPYSK

SEQ ID NO: 1261 - protein, 10 aa, Artificial Sequence
  Artificially synthesized peptide
  SITE (1)..(10): One or more of the listed amino acids can be phosphorylated as set forth in the Tables
SRYSRSPYSL

SEQ ID NO: 1262 - protein, 10 aa, Artificial Sequence
  Artificially synthesized peptide
  SITE (1)..(10): One or more of the listed amino acids can be phosphorylated as set forth in the Tables
SRYSRSPYSF

SEQ ID NO: 1263 - protein, 10 aa, Artificial Sequence
  Artificially synthesized peptide
  SITE (1)..(10): One or more of the listed amino acids can be phosphorylated as set forth in the Tables
SRYSRSPYSY

SEQ ID NO: 1264 - protein, 10 aa, Artificial Sequence
  Artificially synthesized peptide
  SITE (1)..(10): One or more of the listed amino acids can be phosphorylated as set forth in the Tables
SRYSRSPYSK

SEQ ID NO: 1265 - protein, 10 aa, Artificial Sequence
  Artificially synthesized peptide
  SITE (1)..(10): One or more of the listed amino acids can be phosphorylated as set forth in the Tables
SRYSRSPYSL

SEQ ID NO: 1266 - protein, 10 aa, Artificial Sequence
  Artificially synthesized peptide
  SITE (1)..(10): One or more of the listed amino acids can be phosphorylated as set forth in the Tables
SRYSRSPYSF

SEQ ID NO: 1267 - protein, 10 aa, Artificial Sequence
  Artificially synthesized peptide
  SITE (1)..(10): One or more of the listed amino acids can be phosphorylated as set forth in the Tables
SRYSRSPYSY

SEQ ID NO: 1268 - protein, 10 aa, Artificial Sequence
  Artificially synthesized peptide
  SITE (1)..(10): One or more of the listed amino acids can be phosphorylated as set forth in the Tables
SRYSRSPYSK

SEQ ID NO: 1269 - protein, 10 aa, Artificial Sequence
  Artificially synthesized peptide
  SITE (1)..(10): One or more of the listed amino acids can be phosphorylated as set forth in the Tables
ATYTPQAPKY

SEQ ID NO: 1270 - protein, 9 aa, Artificial Sequence
  Artificially synthesized peptide
  SITE (1)..(9): One or more of the listed amino acids can be phosphorylated as set forth in the Tables
ALYTPQAPK

SEQ ID NO: 1271 - protein, 9 aa, Artificial Sequence
  Artificially synthesized peptide
  SITE (1)..(9): One or more of the listed amino acids can be phosphorylated as set forth in the Tables
ALYTPQAPY

SEQ ID NO: 1272 - protein, 11 aa, Artificial Sequence
  Artificially synthesized peptide
  SITE (1)..(11): One or more of the listed amino acids can be phosphorylated as set forth in the Tables
GTIRSRSFIFY

SEQ ID NO: 1273 - protein, 11 aa, Artificial Sequence
  Artificially synthesized peptide
  SITE (1)..(11): One or more of the listed amino acids can be phosphorylated as set forth in the Tables
GLIRSRSFIFK

SEQ ID NO: 1274 - protein, 11 aa, Artificial Sequence
  Artificially synthesized peptide
  SITE (1)..(11): One or more of the listed amino acids can be phosphorylated as set forth in the Tables
GLIRSRSFIFK

SEQ ID NO: 1275 - protein, 11 aa, Artificial Sequence
  Artificially synthesized peptide
  SITE (1)..(11): One or more of the listed amino acids can be phosphorylated as set forth in the Tables
GLIRSRSFIFY

SEQ ID NO: 1276 - protein, 10 aa, Artificial Sequence
  Artificially synthesized peptide
  SITE (1)..(10): One or more of the listed amino acids can be phosphorylated as set forth in the Tables
KLPDSPALAY

SEQ ID NO: 1277 - protein, 10 aa, Artificial Sequence
  Artificially synthesized peptide
  SITE (1)..(10): One or more of the listed amino acids can be phosphorylated as set forth in the Tables
KVPDSPALAK

SEQ ID NO: 1278 - protein, 10 aa, Artificial Sequence
  Artificially synthesized peptide
  SITE (1)..(10): One or more of the listed amino acids can be phosphorylated as set forth in the Tables
KVPDSPALAY

SEQ ID NO: 1279 - protein, 11 aa, Artificial Sequence
  Artificially synthesized peptide
  SITE (1)..(11): One or more of the listed amino acids can be phosphorylated as set forth in the Tables
KLPDSPALAKY

SEQ ID NO: 1280 - protein, 11 aa, Artificial Sequence
  Artificially synthesized peptide
  SITE (1)..(11): One or more of the listed amino acids can be phosphorylated as set forth in the Tables
KVPDSPALAKK

SEQ ID NO: 1281 - protein, 11 aa, Artificial Sequence
  Artificially synthesized peptide
  SITE (1)..(11): One or more of the listed amino acids can be phosphorylated as set forth in the Tables
KVPDSPALAKY

SEQ ID NO: 1282 - protein, 10 aa, Artificial Sequence
  Artificially synthesized peptide
  SITE (1)..(10): One or more of the listed amino acids can be phosphorylated as set forth in the Tables
KMPTTPVKAY

SEQ ID NO: 1283 - protein, 10 aa, Artificial Sequence
  Artificially synthesized peptide
  SITE (1)..(10): One or more of the listed amino acids can be phosphorylated as set forth in the Tables
KLPTTPVKAK

SEQ ID NO: 1284 - protein, 10 aa, Artificial Sequence
  Artificially synthesized peptide
  SITE (1)..(10): One or more of the listed amino acids can be phosphorylated as set forth in the Tables
KLPTTPVKAY

SEQ ID NO: 1285 - protein, 10 aa, Artificial Sequence
  Artificially synthesized peptide
  SITE (1)..(10): One or more of the listed amino acids can be phosphorylated as set forth in the Tables
KTPTSPLKMY

SEQ ID NO: 1286 - protein, 10 aa, Artificial Sequence
  Artificially synthesized peptide
  SITE (1)..(10): One or more of the listed amino acids can be phosphorylated as set forth in the Tables
KLPTSPLKMK

SEQ ID NO: 1287 - protein, 10 aa, Artificial Sequence
  Artificially synthesized peptide
  SITE (1)..(10): One or more of the listed amino acids can be phosphorylated as set forth in the Tables
KLPTSPLKMY

SEQ ID NO: 1288 - protein, 10 aa, Artificial Sequence
  Artificially synthesized peptide
  SITE (1)..(10): One or more of the listed amino acids can be phosphorylated as set forth in the Tables
KVPTSPLKMY

SEQ ID NO: 1289 - protein, 10 aa, Artificial Sequence
  Artificially synthesized peptide
  SITE (1)..(10): One or more of the listed amino acids can be phosphorylated as set forth in the Tables
KVPTSPLKMY

SEQ ID NO: 1290 - protein, 11 aa, Artificial Sequence
  Artificially synthesized peptide
  SITE (1)..(11): One or more of the listed amino acids can be phosphorylated as set forth in the Tables
KVKSSPLIEKY

SEQ ID NO: 1291 - protein, 11 aa, Artificial Sequence
  Artificially synthesized peptide
  SITE (1)..(11): One or more of the listed amino acids can be phosphorylated as set forth in the Tables
KVKSSPLIEKK

SEQ ID NO: 1292 - protein, 11 aa, Artificial Sequence
  Artificially synthesized peptide
  SITE (1)..(11): One or more of the listed amino acids can be phosphorylated as set forth in the Tables
KLKSSPLIEKK

SEQ ID NO: 1293 - protein, 11 aa, Artificial Sequence
  Artificially synthesized peptide
  SITE (1)..(11): One or more of the listed amino acids can be phosphorylated as set forth in the Tables
KLKSSPLIEKY

SEQ ID NO: 1294 - protein, 11 aa, Artificial Sequence
  Artificially synthesized peptide
  SITE (1)..(11): One or more of the listed amino acids can be phosphorylated as set forth in the Tables
KMKSSPLIEKK

SEQ ID NO: 1295 - protein, 9 aa, Artificial Sequence
  Artificially synthesized peptide
  SITE (1)..(9): One or more of the listed amino acids can be phosphorylated as set forth in the Tables
KLLTPIKEK

SEQ ID NO: 1296 - protein, 9 aa, Artificial Sequence
  Artificially synthesized peptide
  SITE (1)..(9): One or more of the listed amino acids can be phosphorylated as set forth in the Tables
KLLTPIKEY

SEQ ID NO: 1297 - protein, 9 aa, Artificial Sequence
  Artificially synthesized peptide
  SITE (1)..(9): One or more of the listed amino acids can be phosphorylated as set forth in the Tables
KVLTPIKEY

SEQ ID NO: 1298 - protein, 9 aa, Artificial Sequence
  Artificially synthesized peptide
  SITE (1)..(9): One or more of the listed amino acids can be phosphorylated as set forth in the Tables
RAKSPISLY

SEQ ID NO: 1299 - protein, 9 aa, Artificial Sequence
  Artificially synthesized peptide
  SITE (1)..(9): One or more of the listed amino acids can be phosphorylated as set forth in the Tables
RLKSPISLK

SEQ ID NO: 1300 - protein, 9 aa, Artificial Sequence
  Artificially synthesized peptide
  SITE (1)..(9): One or more of the listed amino acids can be phosphorylated as set forth in the Tables
RLKSPISLY

SEQ ID NO: 1301 - protein, 9 aa, Artificial Sequence
  Artificially synthesized peptide
  SITE (1)..(9): One or more of the listed amino acids can be phosphorylated as set forth in the Tables
RVKSPISLK

SEQ ID NO: 1302 - protein, 9 aa, Artificial Sequence
  Artificially synthesized peptide
  SITE (1)..(9): One or more of the listed amino acids can be phosphorylated as set forth in the Tables
RILSGVVTY

SEQ ID NO: 1303 - protein, 9 aa, Artificial Sequence
  Artificially synthesized peptide
  SITE (1)..(9): One or more of the listed amino acids can be phosphorylated as set forth in the Tables
RLLSGVVTK

SEQ ID NO: 1304 - protein, 9 aa, Artificial Sequence
  Artificially synthesized peptide
  SITE (1)..(9): One or more of the listed amino acids can be phosphorylated as set forth in the Tables
RVLSGVVTK

SEQ ID NO: 1305 - protein, 9 aa, Artificial Sequence
  Artificially synthesized peptide
  SITE (1)..(9): One or more of the listed amino acids can be phosphorylated as set forth in the Tables
RLLSGVVTY

SEQ ID NO: 1306 - protein, 9 aa, Artificial Sequence
  Artificially synthesized peptide
  SITE (1)..(9): One or more of the listed amino acids can be phosphorylated as set forth in the Tables
RVYQYIQSR

SEQ ID NO: 1307 - protein, 9 aa, Artificial Sequence
  Artificially synthesized peptide
  SITE (1)..(9): One or more of the listed amino acids can be phosphorylated as set forth in the Tables
RMYQYIQSR

SEQ ID NO: 1308 - protein, 9 aa, Artificial Sequence
  Artificially synthesized peptide
  SITE (1)..(9): One or more of the listed amino acids can be phosphorylated as set forth in the Tables
RIYQYIQSK

SEQ ID NO: 1309 - protein, 9 aa, Artificial Sequence
  Artificially synthesized peptide
  SITE (1)..(9): One or more of the listed amino acids can be phosphorylated as set forth in the Tables
RIYQYIQSY

SEQ ID NO: 1310 - protein, 9 aa, Artificial Sequence
  Artificially synthesized peptide
  SITE (1)..(9): One or more of the listed amino acids can be phosphorylated as set forth in the Tables
RLYQYIQSK

SEQ ID NO: 1311 - protein, 9 aa, Artificial Sequence
  Artificially synthesized peptide
  SITE (1)..(9): One or more of the listed amino acids can be phosphorylated as set forth in the Tables
RLYQYIQSY

SEQ ID NO: 1312 - protein, 10 aa, Artificial Sequence
  Artificially synthesized peptide
  SITE (1)..(10): One or more of the listed amino acids can be phosphorylated as set forth in the Tables
RIYQYIQSRY

SEQ ID NO: 1313 - protein, 10 aa, Artificial Sequence
  Artificially synthesized peptide
  SITE (1)..(10): One or more of the listed amino acids can be phosphorylated as set forth in the Tables
RIYQYIQSRK

SEQ ID NO: 1314 - protein, 10 aa, Artificial Sequence
  Artificially synthesized peptide
  SITE (1)..(10): One or more of the listed amino acids can be phosphorylated as set forth in the Tables
RVYQYIQSRK

SEQ ID NO: 1315 - protein, 10 aa, Artificial Sequence
  Artificially synthesized peptide
  SITE (1)..(10): One or more of the listed amino acids can be phosphorylated as set forth in the Tables
RVYQYIQSRY

SEQ ID NO: 1316 - protein, 11 aa, Artificial Sequence
  Artificially synthesized peptide
  SITE (1)..(11): One or more of the listed amino acids can be phosphorylated as set forth in the Tables
RIYQYIQSRFK

SEQ ID NO: 1317 - protein, 11 aa, Artificial Sequence
  Artificially synthesized peptide
  SITE (1)..(11): One or more of the listed amino acids can be phosphorylated as set forth in the Tables
RLYQYIQSRFY

SEQ ID NO: 1318 - protein, 11 aa, Artificial Sequence
  Artificially synthesized peptide
  SITE (1)..(11): One or more of the listed amino acids can be phosphorylated as set forth in the Tables
RVYQYIQSRFY

SEQ ID NO: 1319 - protein, 11 aa, Artificial Sequence
  Artificially synthesized peptide
  SITE (1)..(11): One or more of the listed amino acids can be phosphorylated as set forth in the Tables
RVYQYIQSRFK

SEQ ID NO: 1320 - protein, 11 aa, Artificial Sequence
  Artificially synthesized peptide
  SITE (1)..(11): One or more of the listed amino acids can be phosphorylated as set forth in the Tables
RLYQYIQSRFK

SEQ ID NO: 1321 - protein, 12 aa, Artificial Sequence
  Artificially synthesized peptide
  SITE (1)..(12): One or more of the listed amino acids can be phosphorylated as set forth in the Tables
RLLDRSPSRSAY

SEQ ID NO: 1322 - protein, 12 aa, Artificial Sequence
  Artificially synthesized peptide
  SITE (1)..(12): One or more of the listed amino acids can be phosphorylated as set forth in the Tables
RMLDRSPSRSAK

SEQ ID NO: 1323 - protein, 12 aa, Artificial Sequence
  Artificially synthesized peptide
  SITE (1)..(12): One or more of the listed amino acids can be phosphorylated as set forth in the Tables
RMLDRSPSRSAY

SEQ ID NO: 1324 - protein, 12 aa, Artificial Sequence
  Artificially synthesized peptide
  SITE (1)..(12): One or more of the listed amino acids can be phosphorylated as set forth in the Tables
RVLDRSPSRSAK

SEQ ID NO: 1325 - protein, 12 aa, Artificial Sequence
  Artificially synthesized peptide
  SITE (1)..(12): One or more of the listed amino acids can be phosphorylated as set forth in the Tables
RVLDRSPSRSAY

SEQ ID NO: 1326 - protein, 9 aa, Artificial Sequence
  Artificially synthesized peptide
  SITE (1)..(9): One or more of the listed amino acids can be phosphorylated as set forth in the Tables
RLPSSTLKK

SEQ ID NO: 1327 - protein, 9 aa, Artificial Sequence
  Artificially synthesized peptide
  SITE (1)..(9): One or more of the listed amino acids can be phosphorylated as set forth in the Tables
RLPSSTLKY

SEQ ID NO: 1328 - protein, 9 aa, Artificial Sequence
  Artificially synthesized peptide
  SITE (1)..(9): One or more of the listed amino acids can be phosphorylated as set forth in the Tables
RVPSSTLKK

SEQ ID NO: 1329 - protein, 9 aa, Artificial Sequence
  Artificially synthesized peptide
  SITE (1)..(9): One or more of the listed amino acids can be phosphorylated as set forth in the Tables
RVPSSTLKY

SEQ ID NO: 1330 - protein, 9 aa, Artificial Sequence
  Artificially synthesized peptide
  SITE (1)..(9): One or more of the listed amino acids can be phosphorylated as set forth in the Tables
RLSSPISKK

SEQ ID NO: 1331 - protein, 9 aa, Artificial Sequence
  Artificially synthesized peptide
  SITE (1)..(9): One or more of the listed amino acids can be phosphorylated as set forth in the Tables
RLSSPISKY

SEQ ID NO: 1332 - protein, 9 aa, Artificial Sequence
  Artificially synthesized peptide
  SITE (1)..(9): One or more of the listed amino acids can be phosphorylated as set forth in the Tables
RVSSPISKK

SEQ ID NO: 1333 - protein, 9 aa, Artificial Sequence
  Artificially synthesized peptide
  SITE (1)..(9): One or more of the listed amino acids can be phosphorylated as set forth in the Tables
RVSSPISKY

SEQ ID NO: 1334 - protein, 9 aa, Artificial Sequence
  Artificially synthesized peptide
  SITE (1)..(9): One or more of the listed amino acids can be phosphorylated as set forth in the Tables
RQASPLVHK

SEQ ID NO: 1335 - protein, 9 aa, Artificial Sequence
  Artificially synthesized peptide
  SITE (1)..(9): One or more of the listed amino acids can be phosphorylated as set forth in the Tables
RQASPLVHY

SEQ ID NO: 1336 - protein, 9 aa, Artificial Sequence
  Artificially synthesized peptide
  SITE (1)..(9): One or more of the listed amino acids can be phosphorylated as set forth in the Tables
RLASPLVHK

SEQ ID NO: 1337 - protein, 9 aa, Artificial Sequence
  Artificially synthesized peptide
  SITE (1)..(9): One or more of the listed amino acids can be phosphorylated as set forth in the Tables
RLASPLVHY

SEQ ID NO: 1338 - protein, 9 aa, Artificial Sequence
  Artificially synthesized peptide
  SITE (1)..(9): One or more of the listed amino acids can be phosphorylated as set forth in the Tables
RVASPLVHK

SEQ ID NO: 1339 - protein, 9 aa, Artificial Sequence
  Artificially synthesized peptide
  SITE (1)..(9): One or more of the listed amino acids can be phosphorylated as set forth in the Tables
RVASPLVHY

SEQ ID NO: 1340 - protein, 9 aa, Artificial Sequence
  Artificially synthesized peptide
  SITE (1)..(9): One or more of the listed amino acids can be phosphorylated as set forth in the Tables
RSVSLSMRY

SEQ ID NO: 1341 - protein, 9 aa, Artificial Sequence
  Artificially synthesized peptide
  SITE (1)..(9): One or more of the listed amino acids can be phosphorylated as set forth in the Tables
RLVSLSMRK

SEQ ID NO: 1342 - protein, 9 aa, Artificial Sequence
  Artificially synthesized peptide
  SITE (1)..(9): One or more of the listed amino acids can be phosphorylated as set forth in the Tables
RVVSLSMRK

SEQ ID NO: 1343 - protein, 9 aa, Artificial Sequence
  Artificially synthesized peptide
  SITE (1)..(9): One or more of the listed amino acids can be phosphorylated as set forth in the Tables
RVVSLSMRY

SEQ ID NO: 1344 - protein, 9 aa, Artificial Sequence
  Artificially synthesized peptide
  SITE (1)..(9): One or more of the listed amino acids can be phosphorylated as set forth in the Tables
RLVSLSMRY

SEQ ID NO: 1345 - protein, 9 aa, Artificial Sequence
  Artificially synthesized peptide
  SITE (1)..(9): One or more of the listed amino acids can be phosphorylated as set forth in the Tables
RMVSLSMRK

SEQ ID NO: 1346 - protein, 9 aa, Artificial Sequence
  Artificially synthesized peptide
  SITE (1)..(9): One or more of the listed amino acids can be phosphorylated as set forth in the Tables
RMVSLSMRY

SEQ ID NO: 1347 - protein, 9 aa, Artificial Sequence
  Artificially synthesized peptide
  SITE (1)..(9): One or more of the listed amino acids can be phosphorylated as set forth in the Tables
RSYSRSFSK

SEQ ID NO: 1348 - protein, 9 aa, Artificial Sequence
  Artificially synthesized peptide
  SITE (1)..(9): One or more of the listed amino acids can be phosphorylated as set forth in the Tables
RSYSRSFSY

SEQ ID NO: 1349 - protein, 9 aa, Artificial Sequence
  Artificially synthesized peptide
  SITE (1)..(9): One or more of the listed amino acids can be phosphorylated as set forth in the Tables
RLYSRSFSK

SEQ ID NO: 1350 - protein, 9 aa, Artificial Sequence
  Artificially synthesized peptide
  SITE (1)..(9): One or more of the listed amino acids can be phosphorylated as set forth in the Tables
RLYSRSFSY

SEQ ID NO: 1351 - protein, 9 aa, Artificial Sequence
  Artificially synthesized peptide
  SITE (1)..(9): One or more of the listed amino acids can be phosphorylated as set forth in the Tables
RVYSRSFSK

SEQ ID NO: 1352 - protein, 9 aa, Artificial Sequence
  Artificially synthesized peptide
  SITE (1)..(9): One or more of the listed amino acids can be phosphorylated as set forth in the Tables
RVYSRSFSY

SEQ ID NO: 1353 - protein, 9 aa, Artificial Sequence
  Artificially synthesized peptide
  SITE (1)..(9): One or more of the listed amino acids can be phosphorylated as set forth in the Tables
RTASFAVRY

SEQ ID NO: 1354 - protein, 9 aa, Artificial Sequence
  Artificially synthesized peptide
  SITE (1)..(9): One or more of the listed amino acids can be phosphorylated as set forth in the Tables
RVASFAVRK

SEQ ID NO: 1355 - protein, 9 aa, Artificial Sequence
  Artificially synthesized peptide
  SITE (1)..(9): One or more of the listed amino acids can be phosphorylated as set forth in the Tables
RLASFAVRK

SEQ ID NO: 1356 - protein, 9 aa, Artificial Sequence
  Artificially synthesized peptide
  SITE (1)..(9): One or more of the listed amino acids can be phosphorylated as set forth in the Tables
RLASFAVRY

SEQ ID NO: 1357 - protein, 9 aa, Artificial Sequence
  Artificially synthesized peptide
  SITE (1)..(9): One or more of the listed amino acids can be phosphorylated as set forth in the Tables
RVASFAVRY

SEQ ID NO: 1358 - protein, 10 aa, Artificial Sequence
  Artificially synthesized peptide
  SITE (1)..(10): One or more of the listed amino acids can be phosphorylated as set forth in the Tables
RVASPPPPPK

SEQ ID NO: 1359 - protein, 10 aa, Artificial Sequence
  Artificially synthesized peptide
  SITE (1)..(10): One or more of the listed amino acids can be phosphorylated as set forth in the Tables
RLASPPPPPK

SEQ ID NO: 1360 - protein, 10 aa, Artificial Sequence
  Artificially synthesized peptide
  SITE (1)..(10): One or more of the listed amino acids can be phosphorylated as set forth in the Tables
RVASPPPPPY

SEQ ID NO: 1361 - protein, 10 aa, Artificial Sequence
  Artificially synthesized peptide
  SITE (1)..(10): One or more of the listed amino acids can be phosphorylated as set forth in the Tables
RLASPPPPPY

SEQ ID NO: 1362 - protein, 10 aa, Artificial Sequence
  Artificially synthesized peptide
  SITE (1)..(10): One or more of the listed amino acids can be phosphorylated as set forth in the Tables
RMASPPPPPK

SEQ ID NO: 1363 - protein, 11 aa, Artificial Sequence
  Artificially synthesized peptide
  SITE (1)..(11): One or more of the listed amino acids can be phosphorylated as set forth in the Tables
RVRSLSSLREK

SEQ ID NO: 1364 - protein, 11 aa, Artificial Sequence
  Artificially synthesized peptide
  SITE (1)..(11): One or more of the listed amino acids can be phosphorylated as set forth in the Tables
RMRSLSSLREK

SEQ ID NO: 1365 - protein, 11 aa, Artificial Sequence
  Artificially synthesized peptide
  SITE (1)..(11): One or more of the listed amino acids can be phosphorylated as set forth in the Tables
RLRSLSSLREK

SEQ ID NO: 1366 - protein, 11 aa, Artificial Sequence
  Artificially synthesized peptide
  SITE (1)..(11): One or more of the listed amino acids can be phosphorylated as set forth in the Tables
RTRSLSSLREY

SEQ ID NO: 1367 - protein, 11 aa, Artificial Sequence
  Artificially synthesized peptide
  SITE (1)..(11): One or more of the listed amino acids can be phosphorylated as set forth in the Tables
RVRSLSSLREY

SEQ ID NO: 1368 - protein, 10 aa, Artificial Sequence
  Artificially synthesized peptide
  SITE (1)..(10): One or more of the listed amino acids can be phosphorylated as set forth in the Tables
RVRQSPLATK

SEQ ID NO: 1369 - protein, 10 aa, Artificial Sequence
  Artificially synthesized peptide
  SITE (1)..(10): One or more of the listed amino acids can be phosphorylated as set forth in the Tables
RVRQSPLATY

SEQ ID NO: 1370 - protein, 10 aa, Artificial Sequence
  Artificially synthesized peptide
  SITE (1)..(10): One or more of the listed amino acids can be phosphorylated as set forth in the Tables
RLRQSPLATR

SEQ ID NO: 1371 - protein, 10 aa, Artificial Sequence
  Artificially synthesized peptide
  SITE (1)..(10): One or more of the listed amino acids can be phosphorylated as set forth in the Tables
RLRQSPLATY

SEQ ID NO: 1372 - protein, 10 aa, Artificial Sequence
  Artificially synthesized peptide
  SITE (1)..(10): One or more of the listed amino acids can be phosphorylated as set forth in the Tables
RLRQSPLATK

SEQ ID NO: 1373 - protein, 9 aa, Artificial Sequence
  Artificially synthesized peptide
  SITE (1)..(9): One or more of the listed amino acids can be phosphorylated as set forth in the Tables
RVSSRFSSK

SEQ ID NO: 1374 - protein, 9 aa, Artificial Sequence
  Artificially synthesized peptide
  SITE (1)..(9): One or more of the listed amino acids can be phosphorylated as set forth in the Tables
RVSSRFSSY

SEQ ID NO: 1375 - protein, 9 aa, Artificial Sequence
  Artificially synthesized peptide
  SITE (1)..(9): One or more of the listed amino acids can be phosphorylated as set forth in the Tables
RLSSRFSSR

SEQ ID NO: 1376 - protein, 9 aa, Artificial Sequence
  Artificially synthesized peptide
  SITE (1)..(9): One or more of the listed amino acids can be phosphorylated as set forth in the Tables
RLSSRFSSK

SEQ ID NO: 1377 - protein, 9 aa, Artificial Sequence
  Artificially synthesized peptide
  SITE (1)..(9): One or more of the listed amino acids can be phosphorylated as set forth in the Tables
RLSSRFSSY

SEQ ID NO: 1378 - protein, 10 aa, Artificial Sequence
  Artificially synthesized peptide
  SITE (1)..(10): One or more of the listed amino acids can be phosphorylated as set forth in the Tables
RVSSVKLISY

SEQ ID NO: 1379 - protein, 10 aa, Artificial Sequence
  Artificially synthesized peptide
  SITE (1)..(10): One or more of the listed amino acids can be phosphorylated as set forth in the Tables
RLSSVKLISK

SEQ ID NO: 1380 - protein, 10 aa, Artificial Sequence
  Artificially synthesized peptide
  SITE (1)..(10): One or more of the listed amino acids can be phosphorylated as set forth in the Tables
RLSSVKLISY

SEQ ID NO: 1381 - protein, 10 aa, Artificial Sequence
  Artificially synthesized peptide
  SITE (1)..(10): One or more of the listed amino acids can be phosphorylated as set forth in the Tables
RMSSVKLISK

SEQ ID NO: 1382 - protein, 10 aa, Artificial Sequence
  Artificially synthesized peptide
  SITE (1)..(10): One or more of the listed amino acids can be phosphorylated as set forth in the Tables
RMSSVKLISY

SEQ ID NO: 1383 - protein, 9 aa, Artificial Sequence
  Artificially synthesized peptide
  SITE (1)..(9): One or more of the listed amino acids can be phosphorylated as set forth in the Tables
RVYSPYNHK

SEQ ID NO: 1384 - protein, 9 aa, Artificial Sequence
  Artificially synthesized peptide
  SITE (1)..(9): One or more of the listed amino acids can be phosphorylated as set forth in the Tables
RVYSPYNHY

SEQ ID NO: 1385 - protein, 9 aa, Artificial Sequence
  Artificially synthesized peptide
  SITE (1)..(9): One or more of the listed amino acids can be phosphorylated as set forth in the Tables
RLYSPYNHK

SEQ ID NO: 1386 - protein, 9 aa, Artificial Sequence
  Artificially synthesized peptide
  SITE (1)..(9): One or more of the listed amino acids can be phosphorylated as set forth in the Tables
RLYSPYNHY

SEQ ID NO: 1387 - protein, 9 aa, Artificial Sequence
  Artificially synthesized peptide
  SITE (1)..(9): One or more of the listed amino acids can be phosphorylated as set forth in the Tables
SVRRSVLMY

SEQ ID NO: 1388 - protein, 9 aa, Artificial Sequence
  Artificially synthesized peptide
  SITE (1)..(9): One or more of the listed amino acids can be phosphorylated as set forth in the Tables
SLRRSVLMK

SEQ ID NO: 1389 - protein, 9 aa, Artificial Sequence
  Artificially synthesized peptide
  SITE (1)..(9): One or more of the listed amino acids can be phosphorylated as set forth in the Tables
SLRRSVLMY

SEQ ID NO: 1390 - protein, 9 aa, Artificial Sequence
  Artificially synthesized peptide
  SITE (1)..(9): One or more of the listed amino acids can be phosphorylated as set forth in the Tables
SMRRSVLMK

SEQ ID NO: 1391 - protein, 10 aa, Artificial Sequence
  Artificially synthesized peptide
  SITE (1)..(10): One or more of the listed amino acids can be phosphorylated as set forth in the Tables
GPRPGSPSAV

SEQ ID NO: 1392 - protein, 10 aa, Artificial Sequence
  Artificially synthesized peptide
  SITE (1)..(10): One or more of the listed amino acids can be phosphorylated as set forth in the Tables
GPRPGSPSAM

SEQ ID NO: 1393 - protein, 10 aa, Artificial Sequence
  Artificially synthesized peptide
  SITE (1)..(10): One or more of the listed amino acids can be phosphorylated as set forth in the Tables
GPRPGSPSAF

SEQ ID NO: 1394 - protein, 10 aa, Artificial Sequence
  Artificially synthesized peptide
  SITE (1)..(10): One or more of the listed amino acids can be phosphorylated as set forth in the Tables
HPRSPNVLSL

SEQ ID NO: 1395 - protein, 10 aa, Artificial Sequence
  Artificially synthesized peptide
  SITE (1)..(10): One or more of the listed amino acids can be phosphorylated as set forth in the Tables
HPRSPNVLSM

SEQ ID NO: 1396 - protein, 10 aa, Artificial Sequence
  Artificially synthesized peptide
  SITE (1)..(10): One or more of the listed amino acids can be phosphorylated as set forth in the Tables
HPRSPNVLSF

SEQ ID NO: 1397 - protein, 9 aa, Artificial Sequence
  Artificially synthesized peptide
  SITE (1)..(9): One or more of the listed amino acids can be phosphorylated as set forth in the Tables
KPRSPPRAV

SEQ ID NO: 1398 - protein, 9 aa, Artificial Sequence
  Artificially synthesized peptide
  SITE (1)..(9): One or more of the listed amino acids can be phosphorylated as set forth in the Tables
KPRSPPRAM

SEQ ID NO: 1399 - protein, 9 aa, Artificial Sequence
  Artificially synthesized peptide
  SITE (1)..(9): One or more of the listed amino acids can be phosphorylated as set forth in the Tables
KPRSPPRAF

SEQ ID NO: 1400 - protein, 11 aa, Artificial Sequence
  Artificially synthesized peptide
  SITE (1)..(11): One or more of the listed amino acids can be phosphorylated as set forth in the Tables
KPRSPPRALVV

SEQ ID NO: 1401 - protein, 11 aa, Artificial Sequence
  Artificially synthesized peptide
  SITE (1)..(11): One or more of the listed amino acids can be phosphorylated as set forth in the Tables
KPRSPPRALVM

SEQ ID NO: 1402 - protein, 11 aa, Artificial Sequence
  Artificially synthesized peptide
  SITE (1)..(11): One or more of the listed amino acids can be phosphorylated as set forth in the Tables
KPRSPPRALVF

SEQ ID NO: 1403 - protein, 12 aa, Artificial Sequence
  Artificially synthesized peptide
  SITE (1)..(12): One or more of the listed amino acids can be phosphorylated as set forth in the Tables
KPRSPPRALVLV

SEQ ID NO: 1404 - protein, 12 aa, Artificial Sequence
  Artificially synthesized peptide
  SITE (1)..(12): One or more of the listed amino acids can be phosphorylated as set forth in the Tables
KPRSPPRALVLL

SEQ ID NO: 1405 - protein, 12 aa, Artificial Sequence
  Artificially synthesized peptide
  SITE (1)..(12): One or more of the listed amino acids can be phosphorylated as set forth in the Tables
KPRSPPRALVLM

SEQ ID NO: 1406 - protein, 12 aa, Artificial Sequence
  Artificially synthesized peptide
  SITE (1)..(12): One or more of the listed amino acids can be phosphorylated as set forth in the Tables
KPRSPPRALVLF

SEQ ID NO: 1407 - protein, 9 aa, Artificial Sequence
  Artificially synthesized peptide
  SITE (1)..(9): One or more of the listed amino acids can be phosphorylated as set forth in the Tables
KPRSPVVEV

SEQ ID NO: 1408 - protein, 9 aa, Artificial Sequence
  Artificially synthesized peptide
  SITE (1)..(9): One or more of the listed amino acids can be phosphorylated as set forth in the Tables
KPRSPVVEM

SEQ ID NO: 1409 - protein, 9 aa, Artificial Sequence
  Artificially synthesized peptide
  SITE (1)..(9): One or more of the listed amino acids can be phosphorylated as set forth in the Tables
KPRSPVVEF

SEQ ID NO: 1410 - protein, 8 aa, Artificial Sequence
  Artificially synthesized peptide
  SITE (1)..(8): One or more of the listed amino acids can be phosphorylated as set forth in the Tables
LPASPHQV

SEQ ID NO: 1411 - protein, 8 aa, Artificial Sequence
  Artificially synthesized peptide
  SITE (1)..(8): One or more of the listed amino acids can be phosphorylated as set forth in the Tables
LPASPHQM

SEQ ID NO: 1412 - protein, 8 aa, Artificial Sequence
  Artificially synthesized peptide
  SITE (1)..(8): One or more of the listed amino acids can be phosphorylated as set forth in the Tables
LPASPHQF

SEQ ID NO: 1413 - protein, 9 aa, Artificial Sequence
  Artificially synthesized peptide
  SITE (1)..(9): One or more of the listed amino acids can be phosphorylated as set forth in the Tables
LPIFSRLSV

SEQ ID NO: 1414 - protein, 9 aa, Artificial Sequence
  Artificially synthesized peptide
  SITE (1)..(9): One or more of the listed amino acids can be phosphorylated as set forth in the Tables
LPIFSRLSL

SEQ ID NO: 1415 - protein, 9 aa, Artificial Sequence
  Artificially synthesized peptide
  SITE (1)..(9): One or more of the listed amino acids can be phosphorylated as set forth in the Tables
LPIFSRLSM

SEQ ID NO: 1416 - protein, 9 aa, Artificial Sequence
  Artificially synthesized peptide
  SITE (1)..(9): One or more of the listed amino acids can be phosphorylated as set forth in the Tables
LPIFSRLSF

SEQ ID NO: 1417 - protein, 10 aa, Artificial Sequence
  Artificially synthesized peptide
  SITE (1)..(10): One or more of the listed amino acids can be phosphorylated as set forth in the Tables
LPKSPPYTAV

SEQ ID NO: 1418 - protein, 10 aa, Artificial Sequence
  Artificially synthesized peptide
  SITE (1)..(10): One or more of the listed amino acids can be phosphorylated as set forth in the Tables
LPKSPPYTAL

SEQ ID NO: 1419 - protein, 10 aa, Artificial Sequence
  Artificially synthesized peptide
  SITE (1)..(10): One or more of the listed amino acids can be phosphorylated as set forth in the Tables
LPKSPPYTAM

SEQ ID NO: 1420 - protein, 10 aa, Artificial Sequence
  Artificially synthesized peptide
  SITE (1)..(10): One or more of the listed amino acids can be phosphorylated as set forth in the Tables
MPRQPSATRV

SEQ ID NO: 1421 - protein, 10 aa, Artificial Sequence
  Artificially synthesized peptide
  SITE (1)..(10): One or more of the listed amino acids can be phosphorylated as set forth in the Tables
MPRQPSATRM

SEQ ID NO: 1422 - protein, 10 aa, Artificial Sequence
  Artificially synthesized peptide
  SITE (1)..(10): One or more of the listed amino acids can be phosphorylated as set forth in the Tables
MPRQPSATRF

SEQ ID NO: 1423 - protein, 9 aa, Artificial Sequence
  Artificially synthesized peptide
  SITE (1)..(9): One or more of the listed amino acids can be phosphorylated as set forth in the Tables
RPASAGAMV

SEQ ID NO: 1424 - protein, 9 aa, Artificial Sequence
  Artificially synthesized peptide
  SITE (1)..(9): One or more of the listed amino acids can be phosphorylated as set forth in the Tables
RPASAGAMM

SEQ ID NO: 1425 - protein, 9 aa, Artificial Sequence
  Artificially synthesized peptide
  SITE (1)..(9): One or more of the listed amino acids can be phosphorylated as set forth in the Tables
RPASAGAMF

SEQ ID NO: 1426 - protein, 9 aa, Artificial Sequence
  Artificially synthesized peptide
  SITE (1)..(9): One or more of the listed amino acids can be phosphorylated as set forth in the Tables
RPKSNIVLV

SEQ ID NO: 1427 - protein, 9 aa, Artificial Sequence
  Artificially synthesized peptide
  SITE (1)..(9): One or more of the listed amino acids can be phosphorylated as set forth in the Tables
RPKSNIVLM

SEQ ID NO: 1428 - protein, 9 aa, Artificial Sequence
  Artificially synthesized peptide
  SITE (1)..(9): One or more of the listed amino acids can be phosphorylated as set forth in the Tables
RPKSNIVLF

SEQ ID NO: 1429 - protein, 10 aa, Artificial Sequence
  Artificially synthesized peptide
  SITE (1)..(10): One or more of the listed amino acids can be phosphorylated as set forth in the Tables
RPNSPSPTAV

SEQ ID NO: 1430 - protein, 10 aa, Artificial Sequence
  Artificially synthesized peptide
  SITE (1)..(10): One or more of the listed amino acids can be phosphorylated as set forth in the Tables
RPNSPSPTAM

SEQ ID NO: 1431 - protein, 10 aa, Artificial Sequence
  Artificially synthesized peptide
  SITE (1)..(10): One or more of the listed amino acids can be phosphorylated as set forth in the Tables
RPNSPSPTAF

SEQ ID NO: 1432 - protein, 10 aa, Artificial Sequence
  Artificially synthesized peptide
  SITE (1)..(10): One or more of the listed amino acids can be phosphorylated as set forth in the Tables
RPRSISVEEV

SEQ ID NO: 1433 - protein, 10 aa, Artificial Sequence
  Artificially synthesized peptide
  SITE (1)..(10): One or more of the listed amino acids can be phosphorylated as set forth in the Tables
RPRSISVEEL

SEQ ID NO: 1434 - protein, 10 aa, Artificial Sequence
  Artificially synthesized peptide
  SITE (1)..(10): One or more of the listed amino acids can be phosphorylated as set forth in the Tables
RPRSISVEEM

SEQ ID NO: 1435 - protein, 10 aa, Artificial Sequence
  Artificially synthesized peptide
  SITE (1)..(10): One or more of the listed amino acids can be phosphorylated as set forth in the Tables
RPRSPPPRAV

SEQ ID NO: 1436 - protein, 10 aa, Artificial Sequence
  Artificially synthesized peptide
  SITE (1)..(10): One or more of the listed amino acids can be phosphorylated as set forth in the Tables
RPRSPPPRAL

SEQ ID NO: 1437 - protein, 10 aa, Artificial Sequence
  Artificially synthesized peptide
  SITE (1)..(10): One or more of the listed amino acids can be phosphorylated as set forth in the Tables
RPRSPPPRAF

SEQ ID NO: 1438 - protein, 10 aa, Artificial Sequence
  Artificially synthesized peptide
  SITE (1)..(10): One or more of the listed amino acids can be phosphorylated as set forth in the Tables
RPRSPPPRAM

SEQ ID NO: 1439 - protein, 10 aa, Artificial Sequence
  Artificially synthesized peptide
  SITE (1)..(10): One or more of the listed amino acids can be phosphorylated as set forth in the Tables
RPRSPRQNSV

SEQ ID NO: 1440 - protein, 10 aa, Artificial Sequence
  Artificially synthesized peptide
  SITE (1)..(10): One or more of the listed amino acids can be phosphorylated as set forth in the Tables
RPRSPRQNLI

SEQ ID NO: 1441 - protein, 10 aa, Artificial Sequence
  Artificially synthesized peptide
  SITE (1)..(10): One or more of the listed amino acids can be phosphorylated as set forth in the Tables
RPRSPRQNSM

SEQ ID NO: 1442 - protein, 10 aa, Artificial Sequence
  Artificially synthesized peptide
  SITE (1)..(10): One or more of the listed amino acids can be phosphorylated as set forth in the Tables
RPRSPRQNSF

SEQ ID NO: 1443 - protein, 10 aa, Artificial Sequence
  Artificially synthesized peptide
  SITE (1)..(10): One or more of the listed amino acids can be phosphorylated as set forth in the Tables
RPRPVSPSSV

SEQ ID NO: 1444 - protein, 10 aa, Artificial Sequence
  Artificially synthesized peptide
  SITE (1)..(10): One or more of the listed amino acids can be phosphorylated as set forth in the Tables
RPRPVSPSSM

SEQ ID NO: 1445 - protein, 10 aa, Artificial Sequence
  Artificially synthesized peptide
  SITE (1)..(10): One or more of the listed amino acids can be phosphorylated as set forth in the Tables
RPRPVSPSSF

SEQ ID NO: 1446 - protein, 10 aa, Artificial Sequence
  Artificially synthesized peptide
  SITE (1)..(10): One or more of the listed amino acids can be phosphorylated as set forth in the Tables
RPYSPPFFSV

SEQ ID NO: 1447 - protein, 10 aa, Artificial Sequence
  Artificially synthesized peptide
  SITE (1)..(10): One or more of the listed amino acids can be phosphorylated as set forth in the Tables
RPYSPPFFSM

SEQ ID NO: 1448 - protein, 10 aa, Artificial Sequence
  Artificially synthesized peptide
  SITE (1)..(10): One or more of the listed amino acids can be phosphorylated as set forth in the Tables
RPYSPPFFSF

SEQ ID NO: 1449 - protein, 9 aa, Artificial Sequence
  Artificially synthesized peptide
  SITE (1)..(9): One or more of the listed amino acids can be phosphorylated as set forth in the Tables
SPGSPRPAV

SEQ ID NO: 1450 - protein, 9 aa, Artificial Sequence
  Artificially synthesized peptide
  SITE (1)..(9): One or more of the listed amino acids can be phosphorylated as set forth in the Tables
SPGSPRPAF

SEQ ID NO: 1451 - protein, 9 aa, Artificial Sequence
  Artificially synthesized peptide
  SITE (1)..(9): One or more of the listed amino acids can be phosphorylated as set forth in the Tables
SPGSPRPAM

SEQ ID NO: 1452 - protein, 10 aa, Artificial Sequence
  Artificially synthesized peptide
  SITE (1)..(10): One or more of the listed amino acids can be phosphorylated as set forth in the Tables
SPRRSRSISV

SEQ ID NO: 1453 - protein, 10 aa, Artificial Sequence
  Artificially synthesized peptide
  SITE (1)..(10): One or more of the listed amino acids can be phosphorylated as set forth in the Tables
SPRRSRSISM

SEQ ID NO: 1454 - protein, 10 aa, Artificial Sequence
  Artificially synthesized peptide
  SITE (1)..(10): One or more of the listed amino acids can be phosphorylated as set forth in the Tables
SPRRSRSISF

SEQ ID NO: 1455 - protein, 10 aa, Artificial Sequence
  Artificially synthesized peptide
  SITE (1)..(10): One or more of the listed amino acids can be phosphorylated as set forth in the Tables
SPRSPSTTYV

SEQ ID NO: 1456 - protein, 10 aa, Artificial Sequence
  Artificially synthesized peptide
  SITE (1)..(10): One or more of the listed amino acids can be phosphorylated as set forth in the Tables
SPRSPSTTYM

SEQ ID NO: 1457 - protein, 10 aa, Artificial Sequence
  Artificially synthesized peptide
  SITE (1)..(10): One or more of the listed amino acids can be phosphorylated as set forth in the Tables
SPRSPSTTYF

SEQ ID NO: 1458 - protein, 10 aa, Artificial Sequence
  Artificially synthesized peptide
  SITE (1)..(10): One or more of the listed amino acids can be phosphorylated as set forth in the Tables
VPREVLRLSV

SEQ ID NO: 1459 - protein, 10 aa, Artificial Sequence
  Artificially synthesized peptide
  SITE (1)..(10): One or more of the listed amino acids can be phosphorylated as set forth in the Tables
VPREVLRLSM

SEQ ID NO: 1460 - protein, 10 aa, Artificial Sequence
  Artificially synthesized peptide
  SITE (1)..(10): One or more of the listed amino acids can be phosphorylated as set forth in the Tables
VPREVLRLSF

SEQ ID NO: 1461 - protein, 8 aa, Artificial Sequence
  Artificially synthesized peptide
  SITE (1)..(8): One or more of the listed amino acids can be phosphorylated as set forth in the Tables
ITDGTLKY

SEQ ID NO: 1462 - protein, 8 aa, Artificial Sequence
  Artificially synthesized peptide
  SITE (1)..(8): One or more of the listed amino acids can be phosphorylated as set forth in the Tables
ITEGTLKY

SEQ ID NO: 1463 - protein, 8 aa, Artificial Sequence
  Artificially synthesized peptide
  SITE (1)..(8): One or more of the listed amino acids can be phosphorylated as set forth in the Tables
ISDGTLKY

SEQ ID NO: 1464 - protein, 8 aa, Artificial Sequence
  Artificially synthesized peptide
  SITE (1)..(8): One or more of the listed amino acids can be phosphorylated as set forth in the Tables
ISEGTLKY

SEQ ID NO: 1465 - protein, 8 aa, Artificial Sequence
  Artificially synthesized peptide
  SITE (1)..(8): One or more of the listed amino acids can be phosphorylated as set forth in the Tables
NTESPLRY

SEQ ID NO: 1466 - protein, 8 aa, Artificial Sequence
  Artificially synthesized peptide
  SITE (1)..(8): One or more of the listed amino acids can be phosphorylated as set forth in the Tables
NSDSPLRY

SEQ ID NO: 1467 - protein, 8 aa, Artificial Sequence
  Artificially synthesized peptide
  SITE (1)..(8): One or more of the listed amino acids can be phosphorylated as set forth in the Tables
NSESPLRY

SEQ ID NO: 1468 - protein, 10 aa, Artificial Sequence
  Artificially synthesized peptide
  SITE (1)..(10): One or more of the listed amino acids can be phosphorylated as set forth in the Tables
QTDSPQRALY

SEQ ID NO: 1469 - protein, 10 aa, Artificial Sequence
  Artificially synthesized peptide
  SITE (1)..(10): One or more of the listed amino acids can be phosphorylated as set forth in the Tables
QSDSPQRALY

SEQ ID NO: 1470 - protein, 10 aa, Artificial Sequence
  Artificially synthesized peptide
  SITE (1)..(10): One or more of the listed amino acids can be phosphorylated as set forth in the Tables
QLESPQRALY

SEQ ID NO: 1471 - protein, 10 aa, Artificial Sequence
  Artificially synthesized peptide
  SITE (1)..(10): One or more of the listed amino acids can be phosphorylated as set forth in the Tables
QTESPQRALY

SEQ ID NO: 1472 - protein, 10 aa, Artificial Sequence
  Artificially synthesized peptide
  SITE (1)..(10): One or more of the listed amino acids can be phosphorylated as set forth in the Tables
QSESPQRALY

SEQ ID NO: 1473 - protein, 10 aa, Artificial Sequence
  Artificially synthesized peptide
  SITE (1)..(10): One or more of the listed amino acids can be phosphorylated as set forth in the Tables
HRLSPVKGEK

SEQ ID NO: 1474 - protein, 10 aa, Artificial Sequence
  Artificially synthesized peptide
  SITE (1)..(10): One or more of the listed amino acids can be phosphorylated as set forth in the Tables
HRLSPVKGEY

SEQ ID NO: 1475 - protein, 10 aa, Artificial Sequence
  Artificially synthesized peptide
  SITE (1)..(10): One or more of the listed amino acids can be phosphorylated as set forth in the Tables
HRLSPVKGER

SEQ ID NO: 1476 - protein, 9 aa, Artificial Sequence
  Artificially synthesized peptide
  SITE (1)..(9): One or more of the listed amino acids can be phosphorylated as set forth in the Tables
KRFSFKKSK

SEQ ID NO: 1477 - protein, 9 aa, Artificial Sequence
  Artificially synthesized peptide
  SITE (1)..(9): One or more of the listed amino acids can be phosphorylated as set forth in the Tables
KRFSFKKSY

SEQ ID NO: 1478 - protein, 9 aa, Artificial Sequence
  Artificially synthesized peptide
  SITE (1)..(9): One or more of the listed amino acids can be phosphorylated as set forth in the Tables
KRFSFKKSR

SEQ ID NO: 1479 - protein, 9 aa, Artificial Sequence
  Artificially synthesized peptide
  SITE (1)..(9): One or more of the listed amino acids can be phosphorylated as set forth in the Tables
KRLSPAPQF

SEQ ID NO: 1480 - protein, 9 aa, Artificial Sequence
  Artificially synthesized peptide
  SITE (1)..(9): One or more of the listed amino acids can be phosphorylated as set forth in the Tables
KRLSPAPQK

SEQ ID NO: 1481 - protein, 9 aa, Artificial Sequence
  Artificially synthesized peptide
  SITE (1)..(9): One or more of the listed amino acids can be phosphorylated as set forth in the Tables
KRLSPAPQY

SEQ ID NO: 1482 - protein, 9 aa, Artificial Sequence
  Artificially synthesized peptide
  SITE (1)..(9): One or more of the listed amino acids can be phosphorylated as set forth in the Tables
KRLSPAPQR

SEQ ID NO: 1483 - protein, 8 aa, Artificial Sequence
  Artificially synthesized peptide
  SITE (1)..(8): One or more of the listed amino acids can be phosphorylated as set forth in the Tables
KRMSPKEF

SEQ ID NO: 1484 - protein, 8 aa, Artificial Sequence
  Artificially synthesized peptide
  SITE (1)..(8): One or more of the listed amino acids can be phosphorylated as set forth in the Tables
KRMSPKEK

SEQ ID NO: 1485 - protein, 8 aa, Artificial Sequence
  Artificially synthesized peptide
  SITE (1)..(8): One or more of the listed amino acids can be phosphorylated as set forth in the Tables
KRMSPKEY

SEQ ID NO: 1486 - protein, 8 aa, Artificial Sequence
  Artificially synthesized peptide
  SITE (1)..(8): One or more of the listed amino acids can be phosphorylated as set forth in the Tables
KRMSPKER

SEQ ID NO: 1487 - protein, 10 aa, Artificial Sequence
  Artificially synthesized peptide
  SITE (1)..(10): One or more of the listed amino acids can be phosphorylated as set forth in the Tables
RRASLSEIGY

SEQ ID NO: 1488 - protein, 10 aa, Artificial Sequence
  Artificially synthesized peptide
  SITE (1)..(10): One or more of the listed amino acids can be phosphorylated as set forth in the Tables
RRASLSEIGK

SEQ ID NO: 1489 - protein, 10 aa, Artificial Sequence
  Artificially synthesized peptide
  SITE (1)..(10): One or more of the listed amino acids can be phosphorylated as set forth in the Tables
RRASLSEIGF

SEQ ID NO: 1490 - protein, 9 aa, Artificial Sequence
  Artificially synthesized peptide
  SITE (1)..(9): One or more of the listed amino acids can be phosphorylated as set forth in the Tables
RRDSIVAEF

SEQ ID NO: 1491 - protein, 9 aa, Artificial Sequence
  Artificially synthesized peptide
  SITE (1)..(9): One or more of the listed amino acids can be phosphorylated as set forth in the Tables
RRDSIVAEY

SEQ ID NO: 1492 - protein, 9 aa, Artificial Sequence
  Artificially synthesized peptide
  SITE (1)..(9): One or more of the listed amino acids can be phosphorylated as set forth in the Tables
RRDSIVAEK

SEQ ID NO: 1493 - protein, 9 aa, Artificial Sequence
  Artificially synthesized peptide
  SITE (1)..(9): One or more of the listed amino acids can be phosphorylated as set forth in the Tables
RRDSIVAER

SEQ ID NO: 1494 - protein, 10 aa, Artificial Sequence
  Artificially synthesized peptide
  SITE (1)..(10): One or more of the listed amino acids can be phosphorylated as set forth in the Tables
RRFTPPSPAY

SEQ ID NO: 1495 - protein, 10 aa, Artificial Sequence
  Artificially synthesized peptide
  SITE (1)..(10): One or more of the listed amino acids can be phosphorylated as set forth in the Tables
RRFTPPSPAK

SEQ ID NO: 1496 - protein, 10 aa, Artificial Sequence
  Artificially synthesized peptide
  SITE (1)..(10): One or more of the listed amino acids can be phosphorylated as set forth in the Tables
RRFTPPSPAR

SEQ ID NO: 1497 - protein, 8 aa, Artificial Sequence
  Artificially synthesized peptide
  SITE (1)..(8): One or more of the listed amino acids can be phosphorylated as set forth in the Tables
RRFSRSPK

SEQ ID NO: 1498 - protein, 9 aa, Artificial Sequence
  Artificially synthesized peptide
  SITE (1)..(9): One or more of the listed amino acids can be phosphorylated as set forth in the Tables
RRFSRSPIF

SEQ ID NO: 1499 - protein, 9 aa, Artificial Sequence
  Artificially synthesized peptide
  SITE (1)..(9): One or more of the listed amino acids can be phosphorylated as set forth in the Tables
RRFSRSPIY

SEQ ID NO: 1500 - protein, 9 aa, Artificial Sequence
  Artificially synthesized peptide
  SITE (1)..(9): One or more of the listed amino acids can be phosphorylated as set forth in the Tables
RRFSRSPIK

SEQ ID NO: 1501 - protein, 9 aa, Artificial Sequence
  Artificially synthesized peptide
  SITE (1)..(9): One or more of the listed amino acids can be phosphorylated as set forth in the Tables
RRFSRSPIF

SEQ ID NO: 1502 - protein, 9 aa, Artificial Sequence
  Artificially synthesized peptide
  SITE (1)..(9): One or more of the listed amino acids can be phosphorylated as set forth in the Tables
RRFSRSPIY

SEQ ID NO: 1503 - protein, 10 aa, Artificial Sequence
  Artificially synthesized peptide
  SITE (1)..(10): One or more of the listed amino acids can be phosphorylated as set forth in the Tables
RRFSRSPIRY

SEQ ID NO: 1504 - protein, 10 aa, Artificial Sequence
  Artificially synthesized peptide
  SITE (1)..(10): One or more of the listed amino acids can be phosphorylated as set forth in the Tables
RRFSRSPIRF

SEQ ID NO: 1505 - protein, 10 aa, Artificial Sequence
  Artificially synthesized peptide
  SITE (1)..(10): One or more of the listed amino acids can be phosphorylated as set forth in the Tables
RRFSRSPIRK

SEQ ID NO: 1506 - protein, 10 aa, Artificial Sequence
  Artificially synthesized peptide
  SITE (1)..(10): One or more of the listed amino acids can be phosphorylated as set forth in the Tables
RRIDISPSTY

SEQ ID NO: 1507 - protein, 10 aa, Artificial Sequence
  Artificially synthesized peptide
  SITE (1)..(10): One or more of the listed amino acids can be phosphorylated as set forth in the Tables
RRIDISPSTK

SEQ ID NO: 1508 - protein, 10 aa, Artificial Sequence
  Artificially synthesized peptide
  SITE (1)..(10): One or more of the listed amino acids can be phosphorylated as set forth in the Tables
RRIDISPSTR

SEQ ID NO: 1509 - protein, 10 aa, Artificial Sequence
  Artificially synthesized peptide
  SITE (1)..(10): One or more of the listed amino acids can be phosphorylated as set forth in the Tables
RRISGVDRYF

SEQ ID NO: 1510 - protein, 10 aa, Artificial Sequence
  Artificially synthesized peptide
  SITE (1)..(10): One or more of the listed amino acids can be phosphorylated as set forth in the Tables
RRISGVDRYK

SEQ ID NO: 1511 - protein, 10 aa, Artificial Sequence
  Artificially synthesized peptide
  SITE (1)..(10): One or more of the listed amino acids can be phosphorylated as set forth in the Tables
RRISGVDRYR

SEQ ID NO: 1512 - protein, 9 aa, Artificial Sequence
  Artificially synthesized peptide
  SITE (1)..(9): One or more of the listed amino acids can be phosphorylated as set forth in the Tables
RRLSNLPTF

SEQ ID NO: 1513 - protein, 9 aa, Artificial Sequence
  Artificially synthesized peptide
  SITE (1)..(9): One or more of the listed amino acids can be phosphorylated as set forth in the Tables
RRLSNLPTY

SEQ ID NO: 1514 - protein, 9 aa, Artificial Sequence
  Artificially synthesized peptide
  SITE (1)..(9): One or more of the listed amino acids can be phosphorylated as set forth in the Tables
RRLSNLPTK

SEQ ID NO: 1515 - protein, 9 aa, Artificial Sequence
  Artificially synthesized peptide
  SITE (1)..(9): One or more of the listed amino acids can be phosphorylated as set forth in the Tables
RRLSNLPTR

SEQ ID NO: 1516 - protein, 9 aa, Artificial Sequence
  Artificially synthesized peptide
  SITE (1)..(9): One or more of the listed amino acids can be phosphorylated as set forth in the Tables
RRMSLLSVF

SEQ ID NO: 1517 - protein, 9 aa, Artificial Sequence
  Artificially synthesized peptide
  SITE (1)..(9): One or more of the listed amino acids can be phosphorylated as set forth in the Tables
RRMSLLSVY

SEQ ID NO: 1518 - protein, 9 aa, Artificial Sequence
  Artificially synthesized peptide
  SITE (1)..(9): One or more of the listed amino acids can be phosphorylated as set forth in the Tables
RRMSLLSVK

SEQ ID NO: 1519 - protein, 9 aa, Artificial Sequence
  Artificially synthesized peptide
  SITE (1)..(9): One or more of the listed amino acids can be phosphorylated as set forth in the Tables
RRMSLLSVR

SEQ ID NO: 1520 - protein, 9 aa, Artificial Sequence
  Artificially synthesized peptide
  SITE (1)..(9): One or more of the listed amino acids can be phosphorylated as set forth in the Tables
RRYSPPIQF

SEQ ID NO: 1521 - protein, 9 aa, Artificial Sequence
  Artificially synthesized peptide
  SITE (1)..(9): One or more of the listed amino acids can be phosphorylated as set forth in the Tables
RRYSPPIQY

SEQ ID NO: 1522 - protein, 9 aa, Artificial Sequence
  Artificially synthesized peptide
  SITE (1)..(9): One or more of the listed amino acids can be phosphorylated as set forth in the Tables
RRYSPPIQK

SEQ ID NO: 1523 - protein, 9 aa, Artificial Sequence
  Artificially synthesized peptide
  SITE (1)..(9): One or more of the listed amino acids can be phosphorylated as set forth in the Tables
SRWSGSHQY

SEQ ID NO: 1524 - protein, 9 aa, Artificial Sequence
  Artificially synthesized peptide
  SITE (1)..(9): One or more of the listed amino acids can be phosphorylated as set forth in the Tables
SRWSGSHQK

SEQ ID NO: 1525 - protein, 9 aa, Artificial Sequence
  Artificially synthesized peptide
  SITE (1)..(9): One or more of the listed amino acids can be phosphorylated as set forth in the Tables
SRWSGSHQR

SEQ ID NO: 1526 - protein, 11 aa, Artificial Sequence
  Artificially synthesized peptide
  SITE (1)..(11): One or more of the listed amino acids can be phosphorylated as set forth in the Tables
TRLSPAKIVLK

SEQ ID NO: 1527 - protein, 11 aa, Artificial Sequence
  Artificially synthesized peptide
  SITE (1)..(11): One or more of the listed amino acids can be phosphorylated as set forth in the Tables
TRLSPAKIVLF

SEQ ID NO: 1528 - protein, 11 aa, Artificial Sequence
  Artificially synthesized peptide
  SITE (1)..(11): One or more of the listed amino acids can be phosphorylated as set forth in the Tables
TRLSPAKIVLY

SEQ ID NO: 1529 - protein, 11 aa, Artificial Sequence
  Artificially synthesized peptide
  SITE (1)..(11): One or more of the listed amino acids can be phosphorylated as set forth in the Tables
APRKGSFSALF

SEQ ID NO: 1530 - protein, 11 aa, Artificial Sequence
  Artificially synthesized peptide
  SITE (1)..(11): One or more of the listed amino acids can be phosphorylated as set forth in the Tables
APRKGSFSALL

SEQ ID NO: 1531 - protein, 11 aa, Artificial Sequence
  Artificially synthesized peptide
  SITE (1)..(11): One or more of the listed amino acids can be phosphorylated as set forth in the Tables
APRKGSFSALV

SEQ ID NO: 1532 - protein, 9 aa, Artificial Sequence
  Artificially synthesized peptide
  SITE (1)..(9): One or more of the listed amino acids can be phosphorylated as set forth in the Tables
APRRYSSSF

SEQ ID NO: 1533 - protein, 9 aa, Artificial Sequence
  Artificially synthesized peptide
  SITE: One or more of the listed amino acids can be phosphorylated as set forth in the Tables
APRRYSSSV

SEQ ID NO: 1534 - protein, 9 aa, Artificial Sequence
  Artificially synthesized peptide
  SITE (1)..(9): One or more of the listed amino acids can be phosphorylated as set forth in the Tables
APRRYSSSM

SEQ ID NO: 1535 - protein, 10 aa, Artificial Sequence
  Artificially synthesized peptide
  SITE (1)..(10): One or more of the listed amino acids can be phosphorylated as set forth in the Tables
APRSPPPSRV

SEQ ID NO: 1536 - protein, 10 aa, Artificial Sequence
  Artificially synthesized peptide
  SITE (1)..(10): One or more of the listed amino acids can be phosphorylated as set forth in the Tables
APRSPPPSRL

SEQ ID NO: 1537 - protein, 10 aa, Artificial Sequence
  Artificially synthesized peptide
  SITE (1)..(10): One or more of the listed amino acids can be phosphorylated as set forth in the Tables
APRSPPPSRF

SEQ ID NO: 1538 - protein, 10 aa, Artificial Sequence
  Artificially synthesized peptide
  SITE (1)..(10): One or more of the listed amino acids can be phosphorylated as set forth in the Tables
APRSPPPSRM

SEQ ID NO: 1539 - protein, 9 aa, Artificial Sequence
  Artificially synthesized peptide
  SITE (1)..(9): One or more of the listed amino acids can be phosphorylated as set forth in the Tables
EPKRRSARV

SEQ ID NO: 1540 - protein, 9 aa, Artificial Sequence
  Artificially synthesized peptide
  SITE (1)..(9): One or more of the listed amino acids can be phosphorylated as set forth in the Tables
EPKRRSARM

SEQ ID NO: 1541 - protein, 9 aa, Artificial Sequence
  Artificially synthesized peptide
  SITE (1)..(9): One or more of the listed amino acids can be phosphorylated as set forth in the Tables
EPKRRSARF

SEQ ID NO: 1542 - protein, 9 aa, Artificial Sequence
  Artificially synthesized peptide
  SITE (1)..(9): One or more of the listed amino acids can be phosphorylated as set forth in the Tables
EPRSPSHSL

SEQ ID NO: 1543 - protein, 9 aa, Artificial Sequence
  Artificially synthesized peptide
  SITE (1)..(9): One or more of the listed amino acids can be phosphorylated as set forth in the Tables
EPRSPSHSV

SEQ ID NO: 1544 - protein, 9 aa, Artificial Sequence
  Artificially synthesized peptide
  SITE (1)..(9): One or more of the listed amino acids can be phosphorylated as set forth in the Tables
EPRSPSHSF

SEQ ID NO: 1545 - protein, 9 aa, Artificial Sequence
  Artificially synthesized peptide
  SITE (1)..(9): One or more of the listed amino acids can be phosphorylated as set forth in the Tables
FPHSLLSVV

SEQ ID NO: 1546 - protein, 9 aa, Artificial Sequence
  Artificially synthesized peptide
  SITE (1)..(9): One or more of the listed amino acids can be phosphorylated as set forth in the Tables
FPHSLLSVL

SEQ ID NO: 1547 - protein, 9 aa, Artificial Sequence
  Artificially synthesized peptide
  SITE (1)..(9): One or more of the listed amino acids can be phosphorylated as set forth in the Tables
FPHSLLSVF

SEQ ID NO: 1548 - protein, 9 aa, Artificial Sequence
  Artificially synthesized peptide
  SITE (1)..(9): One or more of the listed amino acids can be phosphorylated as set forth in the Tables
FPHSLLSVM

SEQ ID NO: 1549 - protein, 10 aa, Artificial Sequence
  Artificially synthesized peptide
  SITE (1)..(10): One or more of the listed amino acids can be phosphorylated as set forth in the Tables
FRRSPTKSSV

SEQ ID NO: 1550 - protein, 10 aa, Artificial Sequence
  Artificially synthesized peptide
  SITE (1)..(10): One or more of the listed amino acids can be phosphorylated as set forth in the Tables
FRRSPTKSSM

SEQ ID NO: 1551 - protein, 10 aa, Artificial Sequence
  Artificially synthesized peptide
  SITE (1)..(10): One or more of the listed amino acids can be phosphorylated as set forth in the Tables
FRRSPTKSSF

SEQ ID NO: 1552 - protein, 10 aa, Artificial Sequence
  Artificially synthesized peptide
  SITE (1)..(10): One or more of the listed amino acids can be phosphorylated as set forth in the Tables
FPRSPTKSSL

SEQ ID NO: 1553 - protein, 10 aa, Artificial Sequence
  Artificially synthesized peptide
  SITE (1)..(10): One or more of the listed amino acids can be phosphorylated as set forth in the Tables
FPRSPTKSSV

SEQ ID NO: 1554 - protein, 10 aa, Artificial Sequence
  Artificially synthesized peptide
  SITE (1)..(10): One or more of the listed amino acids can be phosphorylated as set forth in the Tables
FPRSPTKSSM

SEQ ID NO: 1555 - protein, 10 aa, Artificial Sequence
  Artificially synthesized peptide
  SITE (1)..(10): One or more of the listed amino acids can be phosphorylated as set forth in the Tables
FPRSPTKSSF

SEQ ID NO: 1556 - protein, 12 aa, Artificial Sequence
  Artificially synthesized peptide
  SITE (1)..(12): One or more of the listed amino acids can be phosphorylated as set forth in the Tables
FRRSPTKSSLDL

SEQ ID NO: 1557 - protein, 12 aa, Artificial Sequence
  Artificially synthesized peptide
  SITE (1)..(12): One or more of the listed amino acids can be phosphorylated as set forth in the Tables
FRRSPTKSSLDV

SEQ ID NO: 1558 - protein, 12 aa, Artificial Sequence
  Artificially synthesized peptide
  SITE (1)..(12): One or more of the listed amino acids can be phosphorylated as set forth in the Tables
FRRSPTKSSLDF

SEQ ID NO: 1559 - protein, 12 aa, Artificial Sequence
  Artificially synthesized peptide
  SITE (1)..(12): One or more of the listed amino acids can be phosphorylated as set forth in the Tables
FRRSPTKSSLDM

SEQ ID NO: 1560 - protein, 12 aa, Artificial Sequence
  Artificially synthesized peptide
  SITE (1)..(12): One or more of the listed amino acids can be phosphorylated as set forth in the Tables
FPRSPTKSSLDL

SEQ ID NO: 1561 - protein, 12 aa, Artificial Sequence
  Artificially synthesized peptide
  SITE (1)..(12): One or more of the listed amino acids can be phosphorylated as set forth in the Tables
FPRSPTKSSLDV

SEQ ID NO: 1562 - protein, 12 aa, Artificial Sequence
  Artificially synthesized peptide
  SITE (1)..(12): One or more of the listed amino acids can be phosphorylated as set forth in the Tables
FPRSPTKSSLDM

SEQ ID NO: 1563 - protein, 12 aa, Artificial Sequence
  Artificially synthesized peptide
  SITE (1)..(12): One or more of the listed amino acids can be phosphorylated as set forth in the Tables
FPRSPTKSSLDF

SEQ ID NO: 1564 - protein, 8 aa, Artificial Sequence
  Artificially synthesized peptide
  SITE (1)..(8): One or more of the listed amino acids can be phosphorylated as set forth in the Tables
FSISPVRV

SEQ ID NO: 1565 - protein, 8 aa, Artificial Sequence
  Artificially synthesized peptide
  SITE (1)..(8): One or more of the listed amino acids can be phosphorylated as set forth in the Tables
FSISPVRM

SEQ ID NO: 1566 - protein, 8 aa, Artificial Sequence
  Artificially synthesized peptide
  SITE (1)..(8): One or more of the listed amino acids can be phosphorylated as set forth in the Tables
FSISPVRF

SEQ ID NO: 1567 - protein, 8 aa, Artificial Sequence
  Artificially synthesized peptide
  SITE (1)..(8): One or more of the listed amino acids can be phosphorylated as set forth in the Tables
FPISPVRL

SEQ ID NO: 1568 - protein, 8 aa, Artificial Sequence
  Artificially synthesized peptide
  SITE (1)..(8): One or more of the listed amino acids can be phosphorylated as set forth in the Tables
FPISPVRV

SEQ ID NO: 1569 - protein, 8 aa, Artificial Sequence
  Artificially synthesized peptide
  SITE (1)..(8): One or more of the listed amino acids can be phosphorylated as set forth in the Tables
FPISPVRM

SEQ ID NO: 1570 - protein, 8 aa, Artificial Sequence
  Artificially synthesized peptide
  SITE (1)..(8): One or more of the listed amino acids can be phosphorylated as set forth in the Tables
FPISPVRF

SEQ ID NO: 1571 - protein, 9 aa, Artificial Sequence
  Artificially synthesized peptide
  SITE (1)..(9): One or more of the listed amino acids can be phosphorylated as set forth in the Tables
GAQPGRHSF

SEQ ID NO: 1572 - protein, 9 aa, Artificial Sequence
  Artificially synthesized peptide
  SITE (1)..(9): One or more of the listed amino acids can be phosphorylated as set forth in the Tables
GAQPGRHSL

SEQ ID NO: 1573 - protein, 9 aa, Artificial Sequence
  Artificially synthesized peptide
  SITE (1)..(9): One or more of the listed amino acids can be phosphorylated as set forth in the Tables
GPQPGRHSV

SEQ ID NO: 1574 - protein, 9 aa, Artificial Sequence
  Artificially synthesized peptide
  SITE (1)..(9): One or more of the listed amino acids can be phosphorylated as set forth in the Tables
GPQPGRHSF

SEQ ID NO: 1575 - protein, 9 aa, Artificial Sequence
  Artificially synthesized peptide
  SITE (1)..(9): One or more of the listed amino acids can be phosphorylated as set forth in the Tables
GPQPGRHSL

SEQ ID NO: 1576 - protein, 10 aa, Artificial Sequence
  Artificially synthesized peptide
  SITE (1)..(10): One or more of the listed amino acids can be phosphorylated as set forth in the Tables
GPRSASLLSV

SEQ ID NO: 1577 - protein, 10 aa, Artificial Sequence
  Artificially synthesized peptide
  SITE (1)..(10): One or more of the listed amino acids can be phosphorylated as set forth in the Tables
GPRSASLLSF

SEQ ID NO: 1578 - protein, 10 aa, Artificial Sequence
  Artificially synthesized peptide
  SITE (1)..(10): One or more of the listed amino acids can be phosphorylated as set forth in the Tables
GPRSASLLSM

SEQ ID NO: 1579 - protein, 10 aa, Artificial Sequence
  Artificially synthesized peptide
  SITE (1)..(10): One or more of the listed amino acids can be phosphorylated as set forth in the Tables
GPRSASLLSV

SEQ ID NO: 1580 - protein, 10 aa, Artificial Sequence
  Artificially synthesized peptide
  SITE (1)..(10): One or more of the listed amino acids can be phosphorylated as set forth in the Tables
GPRSASLLSF

SEQ ID NO: 1581 - protein, 10 aa, Artificial Sequence
  Artificially synthesized peptide
  SITE (1)..(10): One or more of the listed amino acids can be phosphorylated as set forth in the Tables
GPRSASLLSM

SEQ ID NO: 1582 - protein, 10 aa, Artificial Sequence
  Artificially synthesized peptide
  SITE (1)..(10): One or more of the listed amino acids can be phosphorylated as set forth in the Tables
GPRSASLLSV

SEQ ID NO: 1583 - protein, 10 aa, Artificial Sequence
  Artificially synthesized peptide
  SITE (1)..(10): One or more of the listed amino acids can be phosphorylated as set forth in the Tables
GPRSASLLSF

SEQ ID NO: 1584 - protein, 10 aa, Artificial Sequence
  Artificially synthesized peptide
  SITE (1)..(10): One or more of the listed amino acids can be phosphorylated as set forth in the Tables
GPRSASLLSM

SEQ ID NO: 1585 - protein, 9 aa, Artificial Sequence
  Artificially synthesized peptide
  SITE (1)..(9): One or more of the listed amino acids can be phosphorylated as set forth in the Tables
HPSSPTPTV

SEQ ID NO: 1586 - protein, 9 aa, Artificial Sequence
  Artificially synthesized peptide
  SITE (1)..(9): One or more of the listed amino acids can be phosphorylated as set forth in the Tables
HPRSPTPTF

SEQ ID NO: 1587 - protein, 9 aa, Artificial Sequence
  Artificially synthesized peptide
  SITE (1)..(9): One or more of the listed amino acids can be phosphorylated as set forth in the Tables
HPRSPTPTM

SEQ ID NO: 1588 - protein, 9 aa, Artificial Sequence
  Artificially synthesized peptide
  SITE (1)..(9): One or more of the listed amino acids can be phosphorylated as set forth in the Tables
HPRSPTPTV

SEQ ID NO: 1589 - protein, 9 aa, Artificial Sequence
  Artificially synthesized peptide
  SITE (1)..(9): One or more of the listed amino acids can be phosphorylated as set forth in the Tables
HPRSPTPTF

SEQ ID NO: 1590 - protein, 9 aa, Artificial Sequence
  Artificially synthesized peptide
  SITE (1)..(9): One or more of the listed amino acids can be phosphorylated as set forth in the Tables
HPRSPTPTM

SEQ ID NO: 1591 - protein, 9 aa, Artificial Sequence
  Artificially synthesized peptide
  SITE (1)..(9): One or more of the listed amino acids can be phosphorylated as set forth in the Tables
KARSPGRAV

SEQ ID NO: 1592 - protein, 9 aa, Artificial Sequence
  Artificially synthesized peptide
  SITE (1)..(9): One or more of the listed amino acids can be phosphorylated as set forth in the Tables
KARSPGRAF

SEQ ID NO: 1593 - protein, 9 aa, Artificial Sequence
  Artificially synthesized peptide
  SITE (1)..(9): One or more of the listed amino acids can be phosphorylated as set forth in the Tables
KARSPGRAM

SEQ ID NO: 1594 - protein, 9 aa, Artificial Sequence
  Artificially synthesized peptide
  SITE (1)..(9): One or more of the listed amino acids can be phosphorylated as set forth in the Tables
KPASPARRV

SEQ ID NO: 1595 - protein, 9 aa, Artificial Sequence
  Artificially synthesized peptide
  SITE (1)..(9): One or more of the listed amino acids can be phosphorylated as set forth in the Tables
KPASPARRF

SEQ ID NO: 1596 - protein, 9 aa, Artificial Sequence
  Artificially synthesized peptide
  SITE (1)..(9): One or more of the listed amino acids can be phosphorylated as set forth in the Tables
KPASPARRM

SEQ ID NO: 1597 - protein, 11 aa, Artificial Sequence
  Artificially synthesized peptide
  SITE (1)..(11): One or more of the listed amino acids can be phosphorylated as set forth in the Tables
KPASPKFIVTV

SEQ ID NO: 1598 - protein, 11 aa, Artificial Sequence
  Artificially synthesized peptide
  SITE (1)..(11): One or more of the listed amino acids can be phosphorylated as set forth in the Tables
KPASPKFIVTF

SEQ ID NO: 1599 - protein, 11 aa, Artificial Sequence
  Artificially synthesized peptide
  SITE (1)..(11): One or more of the listed amino acids can be phosphorylated as set forth in the Tables
KPASPKFIVTM

SEQ ID NO: 1600 - protein, 9 aa, Artificial Sequence
  Artificially synthesized peptide
  SITE (1)..(9): One or more of the listed amino acids can be phosphorylated as set forth in the Tables
KPPHSPLVM

SEQ ID NO: 1601 - protein, 9 aa, Artificial Sequence
  Artificially synthesized peptide
  SITE (1)..(9): One or more of the listed amino acids can be phosphorylated as set forth in the Tables
KPPHSPLVV

SEQ ID NO: 1602 - protein, 9 aa, Artificial Sequence
  Artificially synthesized peptide
  SITE (1)..(9): One or more of the listed amino acids can be phosphorylated as set forth in the Tables
KPPHSPLVF

SEQ ID NO: 1603 - protein, 10 aa, Artificial Sequence
  Artificially synthesized peptide
  SITE (1)..(10): One or more of the listed amino acids can be phosphorylated as set forth in the Tables
KPPSPEHQSV

SEQ ID NO: 1604 - protein, 10 aa, Artificial Sequence
  Artificially synthesized peptide
  SITE (1)..(10): One or more of the listed amino acids can be phosphorylated as set forth in the Tables
KPPSPEHQSF

SEQ ID NO: 1605 - protein, 10 aa, Artificial Sequence
  Artificially synthesized peptide
  SITE (1)..(10): One or more of the listed amino acids can be phosphorylated as set forth in the Tables
KPPSPEHQSM

SEQ ID NO: 1606 - protein, 10 aa, Artificial Sequence
  Artificially synthesized peptide
  SITE (1)..(10): One or more of the listed amino acids can be phosphorylated as set forth in the Tables
KPPSPSPIEL

SEQ ID NO: 1607 - protein, 10 aa, Artificial Sequence
  Artificially synthesized peptide
  SITE (1)..(10): One or more of the listed amino acids can be phosphorylated as set forth in the Tables
KPPSPSPIEV

SEQ ID NO: 1608 - protein, 10 aa, Artificial Sequence
  Artificially synthesized peptide
  SITE (1)..(10): One or more of the listed amino acids can be phosphorylated as set forth in the Tables
KPPSPSPIEF

SEQ ID NO: 1609 - protein, 9 aa, Artificial Sequence
  Artificially synthesized peptide
  SITE (1)..(9): One or more of the listed amino acids can be phosphorylated as set forth in the Tables
KPPTPGASL

SEQ ID NO: 1610 - protein, 9 aa, Artificial Sequence
  Artificially synthesized peptide
  SITE (1)..(9): One or more of the listed amino acids can be phosphorylated as set forth in the Tables
KPPTPGASV

SEQ ID NO: 1611 - protein, 9 aa, Artificial Sequence
  Artificially synthesized peptide
  SITE (1)..(9): One or more of the listed amino acids can be phosphorylated as set forth in the Tables
KPPTPGASM

SEQ ID NO: 1612 - protein, 9 aa, Artificial Sequence
  Artificially synthesized peptide
  SITE (1)..(9): One or more of the listed amino acids can be phosphorylated as set forth in the Tables
KPPYRSHSV

SEQ ID NO: 1613 - protein, 9 aa, Artificial Sequence
  Artificially synthesized peptide
  SITE (1)..(9): One or more of the listed amino acids can be phosphorylated as set forth in the Tables
KPPYRSHSF

SEQ ID NO: 1614 - protein, 9 aa, Artificial Sequence
  Artificially synthesized peptide
  SITE (1)..(9): One or more of the listed amino acids can be phosphorylated as set forth in the Tables
KPPYRSHSM

SEQ ID NO: 1615 - protein, 9 aa, Artificial Sequence
  Artificially synthesized peptide
  SITE (1)..(9): One or more of the listed amino acids can be phosphorylated as set forth in the Tables
KPQTRGKTL

SEQ ID NO: 1616 - protein, 9 aa, Artificial Sequence
  Artificially synthesized peptide
  SITE (1)..(9): One or more of the listed amino acids can be phosphorylated as set forth in the Tables
KPQTRGKTV

SEQ ID NO: 1617 - protein, 9 aa, Artificial Sequence
  Artificially synthesized peptide
  SITE (1)..(9): One or more of the listed amino acids can be phosphorylated as set forth in the Tables
KPQTRGKTM

SEQ ID NO: 1618 - protein, 9 aa, Artificial Sequence
  Artificially synthesized peptide
  SITE (1)..(9): One or more of the listed amino acids can be phosphorylated as set forth in the Tables
KPRPPPLSL

SEQ ID NO: 1619 - protein, 9 aa, Artificial Sequence
  Artificially synthesized peptide
  SITE (1)..(9): One or more of the listed amino acids can be phosphorylated as set forth in the Tables
KPRPPPLSV

SEQ ID NO: 1620 - protein, 9 aa, Artificial Sequence
  Artificially synthesized peptide
  SITE (1)..(9): One or more of the listed amino acids can be phosphorylated as set forth in the Tables
KPRPPPLSF

SEQ ID NO: 1621 - protein, 9 aa, Artificial Sequence
  Artificially synthesized peptide
  SITE (1)..(9): One or more of the listed amino acids can be phosphorylated as set forth in the Tables
KPRPPPLSM

SEQ ID NO: 1622 - protein, 9 aa, Artificial Sequence
  Artificially synthesized peptide
  SITE (1)..(9): One or more of the listed amino acids can be phosphorylated as set forth in the Tables
KPRSPDHVV

SEQ ID NO: 1623 - protein, 9 aa, Artificial Sequence
  Artificially synthesized peptide
  SITE (1)..(9): One or more of the listed amino acids can be phosphorylated as set forth in the Tables
KPRSPDHVF

SEQ ID NO: 1624 - protein, 9 aa, Artificial Sequence
  Artificially synthesized peptide
  SITE (1)..(9): One or more of the listed amino acids can be phosphorylated as set forth in the Tables
KPRSPDHVM

SEQ ID NO: 1625 - protein, 9 aa, Artificial Sequence
  Artificially synthesized peptide
  SITE (1)..(9): One or more of the listed amino acids can be phosphorylated as set forth in the Tables
KPRSPPRAV

SEQ ID NO: 1626 - protein, 9 aa, Artificial Sequence
  Artificially synthesized peptide
  SITE (1)..(9): One or more of the listed amino acids can be phosphorylated as set forth in the Tables
KPRSPPRAF

SEQ ID NO: 1627 - protein, 9 aa, Artificial Sequence
  Artificially synthesized peptide
  SITE (1)..(9): One or more of the listed amino acids can be phosphorylated as set forth in the Tables
KPRSPPRAM

SEQ ID NO: 1628 - protein, 10 aa, Artificial Sequence
  Artificially synthesized peptide
  SITE (1)..(10): One or more of the listed amino acids can be phosphorylated as set forth in the Tables
KPRSPPRALM

SEQ ID NO: 1629 - protein, 10 aa, Artificial Sequence
  Artificially synthesized peptide
  SITE (1)..(10): One or more of the listed amino acids can be phosphorylated as set forth in the Tables
KPRSPPRALL

SEQ ID NO: 1630 - protein, 10 aa, Artificial Sequence
  Artificially synthesized peptide
  SITE (1)..(10): One or more of the listed amino acids can be phosphorylated as set forth in the Tables
KPRSPPRALF

SEQ ID NO: 1631 - protein, 11 aa, Artificial Sequence
  Artificially synthesized peptide
  SITE (1)..(11): One or more of the listed amino acids can be phosphorylated as set forth in the Tables
KPRSPPRALVV

SEQ ID NO: 1632 - protein, 11 aa, Artificial Sequence
  Artificially synthesized peptide
  SITE (1)..(11): One or more of the listed amino acids can be phosphorylated as set forth in the Tables
KPRSPPRALVF

SEQ ID NO: 1633 - protein, 11 aa, Artificial Sequence
  Artificially synthesized peptide
  SITE (1)..(11): One or more of the listed amino acids can be phosphorylated as set forth in the Tables
KPRSPPRALVM

SEQ ID NO: 1634 - protein, 9 aa, Artificial Sequence
  Artificially synthesized peptide
  SITE (1)..(9): One or more of the listed amino acids can be phosphorylated as set forth in the Tables
KPRSPVVEV

SEQ ID NO: 1635 - protein, 9 aa, Artificial Sequence
  Artificially synthesized peptide
  SITE (1)..(9): One or more of the listed amino acids can be phosphorylated as set forth in the Tables
KPRSPVVEF

SEQ ID NO: 1636 - protein, 9 aa, Artificial Sequence
  Artificially synthesized peptide
  SITE (1)..(9): One or more of the listed amino acids can be phosphorylated as set forth in the Tables
KPRSPVVEM

SEQ ID NO: 1637 - protein, 9 aa, Artificial Sequence
  Artificially synthesized peptide
  SITE (1)..(9): One or more of the listed amino acids can be phosphorylated as set forth in the Tables
KPYSPLASV

SEQ ID NO: 1638 - protein, 9 aa, Artificial Sequence
  Artificially synthesized peptide
  SITE (1)..(9): One or more of the listed amino acids can be phosphorylated as set forth in the Tables
KPYSPLASF

SEQ ID NO: 1639 - protein, 9 aa, Artificial Sequence
  Artificially synthesized peptide
  SITE (1)..(9): One or more of the listed amino acids can be phosphorylated as set forth in the Tables
KPYSPLASM

SEQ ID NO: 1640 - protein, 9 aa, Artificial Sequence
  Artificially synthesized peptide
  SITE (1)..(9): One or more of the listed amino acids can be phosphorylated as set forth in the Tables
LPASPRARV

SEQ ID NO: 1641 - protein, 9 aa, Artificial Sequence
  Artificially synthesized peptide
  SITE (1)..(9): One or more of the listed amino acids can be phosphorylated as set forth in the Tables
LPASPRARF

SEQ ID NO: 1642 - protein, 9 aa, Artificial Sequence
  Artificially synthesized peptide
  SITE (1)..(9): One or more of the listed amino acids can be phosphorylated as set forth in the Tables
LPASPRARM

SEQ ID NO: 1643 - protein, 9 aa, Artificial Sequence
  Artificially synthesized peptide
  SITE (1)..(9): One or more of the listed amino acids can be phosphorylated as set forth in the Tables
LPIFSRLSL

SEQ ID NO: 1644 - protein, 9 aa, Artificial Sequence
  Artificially synthesized peptide
  SITE (1)..(9): One or more of the listed amino acids can be phosphorylated as set forth in the Tables
LPIFSRLSV

SEQ ID NO: 1645 - protein, 9 aa, Artificial Sequence
  Artificially synthesized peptide
  SITE (1)..(9): One or more of the listed amino acids can be phosphorylated as set forth in the Tables
LPIFSRLSF

SEQ ID NO: 1646 - protein, 9 aa, Artificial Sequence
  Artificially synthesized peptide
  SITE (1)..(9): One or more of the listed amino acids can be phosphorylated as set forth in the Tables
LPIFSRLSM

SEQ ID NO: 1647 - protein, 10 aa, Artificial Sequence
  Artificially synthesized peptide
  SITE (1)..(10): One or more of the listed amino acids can be phosphorylated as set forth in the Tables
LPKSPPYTAV

SEQ ID NO: 1648 - protein, 10 aa, Artificial Sequence
  Artificially synthesized peptide
  SITE (1)..(10): One or more of the listed amino acids can be phosphorylated as set forth in the Tables
LPKSPPYTAL

SEQ ID NO: 1649 - protein, 10 aa, Artificial Sequence
  Artificially synthesized peptide
  SITE (1)..(10): One or more of the listed amino acids can be phosphorylated as set forth in the Tables
LPKSPPYTAM

SEQ ID NO: 1650 - protein, 10 aa, Artificial Sequence
  Artificially synthesized peptide
  SITE (1)..(10): One or more of the listed amino acids can be phosphorylated as set forth in the Tables
LPRGSSPSVV

SEQ ID NO: 1651 - protein, 10 aa, Artificial Sequence
  Artificially synthesized peptide
  SITE (1)..(10): One or more of the listed amino acids can be phosphorylated as set forth in the Tables
LPRGSSPSVF

SEQ ID NO: 1652 - protein, 10 aa, Artificial Sequence
  Artificially synthesized peptide
  SITE (1)..(10): One or more of the listed amino acids can be phosphorylated as set forth in the Tables
LPRGSSPSVM

SEQ ID NO: 1653 - protein, 10 aa, Artificial Sequence
  Artificially synthesized peptide
  SITE (1)..(10): One or more of the listed amino acids can be phosphorylated as set forth in the Tables
MPRQPSATRV

SEQ ID NO: 1654 - protein, 10 aa, Artificial Sequence
  Artificially synthesized peptide
  SITE (1)..(10): One or more of the listed amino acids can be phosphorylated as set forth in the Tables
MPRQPSATRF

SEQ ID NO: 1655 - protein, 10 aa, Artificial Sequence
  Artificially synthesized peptide
  SITE (1)..(10): One or more of the listed amino acids can be phosphorylated as set forth in the Tables
MPRQPSATRM

SEQ ID NO: 1656 - protein, 11 aa, Artificial Sequence
  Artificially synthesized peptide
  SITE (1)..(11): One or more of the listed amino acids can be phosphorylated as set forth in the Tables
QPRSPGPDYSV

SEQ ID NO: 1657 - protein, 11 aa, Artificial Sequence
  Artificially synthesized peptide
  SITE (1)..(11): One or more of the listed amino acids can be phosphorylated as set forth in the Tables
QPRSPGPDYSF

SEQ ID NO: 1658 - protein, 11 aa, Artificial Sequence
  Artificially synthesized peptide
  SITE (1)..(11): One or more of the listed amino acids can be phosphorylated as set forth in the Tables
QPRSPGPDYSM

SEQ ID NO: 1659 - protein, 10 aa, Artificial Sequence
  Artificially synthesized peptide
  SITE (1)..(10): One or more of the listed amino acids can be phosphorylated as set forth in the Tables
QPRTPSPLVV

SEQ ID NO: 1660 - protein, 10 aa, Artificial Sequence
  Artificially synthesized peptide
  SITE (1)..(10): One or more of the listed amino acids can be phosphorylated as set forth in the Tables
QPRTPSPLVF

SEQ ID NO: 1661 - protein, 10 aa, Artificial Sequence
  Artificially synthesized peptide
  SITE (1)..(10): One or more of the listed amino acids can be phosphorylated as set forth in the Tables
QPRTPSPLVM

SEQ ID NO: 1662 - protein, 10 aa, Artificial Sequence
  Artificially synthesized peptide
  SITE (1)..(10): One or more of the listed amino acids can be phosphorylated as set forth in the Tables
QPRTPSPLVV

SEQ ID NO: 1663 - protein, 10 aa, Artificial Sequence
  Artificially synthesized peptide
  SITE (1)..(10): One or more of the listed amino acids can be phosphorylated as set forth in the Tables
QPRTPSPLVF

SEQ ID NO: 1664 - protein, 10 aa, Artificial Sequence
  Artificially synthesized peptide
  SITE (1)..(10): One or more of the listed amino acids can be phosphorylated as set forth in the Tables
QPRTPSPLVM

SEQ ID NO: 1665 - protein, 9 aa, Artificial Sequence
  Artificially synthesized peptide
  SITE (1)..(9): One or more of the listed amino acids can be phosphorylated as set forth in the Tables
RAPSPSSRL

SEQ ID NO: 1666 - protein, 9 aa, Artificial Sequence
  Artificially synthesized peptide
  SITE (1)..(9): One or more of the listed amino acids can be phosphorylated as set forth in the Tables
RAPSPSSRV

SEQ ID NO: 1667 - protein, 9 aa, Artificial Sequence
  Artificially synthesized peptide
  SITE (1)..(9): One or more of the listed amino acids can be phosphorylated as set forth in the Tables
RAPSPSSRF

SEQ ID NO: 1668 - protein, 9 aa, Artificial Sequence
  Artificially synthesized peptide
  SITE (1)..(9): One or more of the listed amino acids can be phosphorylated as set forth in the Tables
RPPSPSSRM

SEQ ID NO: 1669 - protein, 9 aa, Artificial Sequence
  Artificially synthesized peptide
  SITE (1)..(9): One or more of the listed amino acids can be phosphorylated as set forth in the Tables
RPPSPSSRL

SEQ ID NO: 1670 - protein, 9 aa, Artificial Sequence
  Artificially synthesized peptide
  SITE (1)..(9): One or more of the listed amino acids can be phosphorylated as set forth in the Tables
RPPSPSSRV

SEQ ID NO: 1671 - protein, 9 aa, Artificial Sequence
  Artificially synthesized peptide
  SITE (1)..(9): One or more of the listed amino acids can be phosphorylated as set forth in the Tables
RPPSPSSRF

SEQ ID NO: 1672 - protein, 8 aa, Artificial Sequence
  Artificially synthesized peptide
  SITE (1)..(8): One or more of the listed amino acids can be phosphorylated as set forth in the Tables
RPAKSMDV

SEQ ID NO: 1673 - protein, 9 aa, Artificial Sequence
  Artificially synthesized peptide
  SITE (1)..(9): One or more of the listed amino acids can be phosphorylated as set forth in the Tables
RPAKSMDSF

SEQ ID NO: 1674 - protein, 9 aa, Artificial Sequence
  Artificially synthesized peptide
  SITE (1)..(9): One or more of the listed amino acids can be phosphorylated as set forth in the Tables
RPAKSMDSM

SEQ ID NO: 1675 - protein, 9 aa, Artificial Sequence
  Artificially synthesized peptide
  SITE (1)..(9): One or more of the listed amino acids can be phosphorylated as set forth in the Tables
RPASAGAMV

SEQ ID NO: 1676 - protein, 9 aa, Artificial Sequence
  Artificially synthesized peptide
  SITE (1)..(9): One or more of the listed amino acids can be phosphorylated as set forth in the Tables
RPASAGAMF

SEQ ID NO: 1677 - protein, 9 aa, Artificial Sequence
  Artificially synthesized peptide
  SITE (1)..(9): One or more of the listed amino acids can be phosphorylated as set forth in the Tables
RPASAGAMM

SEQ ID NO: 1678 - protein, 11 aa, Artificial Sequence
  Artificially synthesized peptide
  SITE (1)..(11): One or more of the listed amino acids can be phosphorylated as set forth in the Tables
RPASARAQPGV

SEQ ID NO: 1679 - protein, 11 aa, Artificial Sequence
  Artificially synthesized peptide
  SITE (1)..(11): One or more of the listed amino acids can be phosphorylated as set forth in the Tables
RPASARAQPGF

SEQ ID NO: 1680 - protein, 11 aa, Artificial Sequence
  Artificially synthesized peptide
  SITE (1)..(11): One or more of the listed amino acids can be phosphorylated as set forth in the Tables
RPASARAQPGM

SEQ ID NO: 1681 - protein, 9 aa, Artificial Sequence
  Artificially synthesized peptide
  SITE (1)..(9): One or more of the listed amino acids can be phosphorylated as set forth in the Tables
RPASPAAKV

SEQ ID NO: 1682 - protein, 9 aa, Artificial Sequence
  Artificially synthesized peptide
  SITE (1)..(9): One or more of the listed amino acids can be phosphorylated as set forth in the Tables
RPASPAAKF

SEQ ID NO: 1683 - protein, 9 aa, Artificial Sequence
  Artificially synthesized peptide
  SITE (1)..(9): One or more of the listed amino acids can be phosphorylated as set forth in the Tables
RPASPAAKM

SEQ ID NO: 1684 - protein, 10 aa, Artificial Sequence
  Artificially synthesized peptide
  SITE (1)..(10): One or more of the listed amino acids can be phosphorylated as set forth in the Tables
RPATGGPGVL

SEQ ID NO: 1685 - protein, 10 aa, Artificial Sequence
  Artificially synthesized peptide
  SITE (1)..(10): One or more of the listed amino acids can be phosphorylated as set forth in the Tables
RPATGGPGVV

SEQ ID NO: 1686 - protein, 10 aa, Artificial Sequence
  Artificially synthesized peptide
  SITE (1)..(10): One or more of the listed amino acids can be phosphorylated as set forth in the Tables
RPATGGPGVF

SEQ ID NO: 1687 - protein, 10 aa, Artificial Sequence
  Artificially synthesized peptide
  SITE (1)..(10): One or more of the listed amino acids can be phosphorylated as set forth in the Tables
RPATGGPGVM

SEQ ID NO: 1688 - protein, 9 aa, Artificial Sequence
  Artificially synthesized peptide
  SITE (1)..(9): One or more of the listed amino acids can be phosphorylated as set forth in the Tables
RPATPTSQV

SEQ ID NO: 1689 - protein, 9 aa, Artificial Sequence
  Artificially synthesized peptide
  SITE (1)..(9): One or more of the listed amino acids can be phosphorylated as set forth in the Tables
RPATPTSQL

SEQ ID NO: 1690 - protein, 9 aa, Artificial Sequence
  Artificially synthesized peptide
  SITE (1)..(9): One or more of the listed amino acids can be phosphorylated as set forth in the Tables
RPATPTSQM

SEQ ID NO: 1691 - protein, 11 aa, Artificial Sequence
  Artificially synthesized peptide
  SITE (1)..(11): One or more of the listed amino acids can be phosphorylated as set forth in the Tables
RPDSRLGKTEV

SEQ ID NO: 1692 - protein, 11 aa, Artificial Sequence
  Artificially synthesized peptide
  SITE (1)..(11): One or more of the listed amino acids can be phosphorylated as set forth in the Tables
RPDSRLGKTEF

SEQ ID NO: 1693 - protein, 11 aa, Artificial Sequence
  Artificially synthesized peptide
  SITE (1)..(11): One or more of the listed amino acids can be phosphorylated as set forth in the Tables
RPDSRLGKTEM

SEQ ID NO: 1694 - protein, 9 aa, Artificial Sequence
  Artificially synthesized peptide
  SITE (1)..(9): One or more of the listed amino acids can be phosphorylated as set forth in the Tables
RPFSPREAV

SEQ ID NO: 1695 - protein, 9 aa, Artificial Sequence
  Artificially synthesized peptide
  SITE (1)..(9): One or more of the listed amino acids can be phosphorylated as set forth in the Tables
RPFSPREAM

SEQ ID NO: 1696 - protein, 9 aa, Artificial Sequence
  Artificially synthesized peptide
  SITE (1)..(9): One or more of the listed amino acids can be phosphorylated as set forth in the Tables
RPFSPREAF

SEQ ID NO: 1697 - protein, 9 aa, Artificial Sequence
  Artificially synthesized peptide
  SITE (1)..(9): One or more of the listed amino acids can be phosphorylated as set forth in the Tables
RPHSPEKAL

SEQ ID NO: 1698 - protein, 9 aa, Artificial Sequence
  Artificially synthesized peptide
  SITE (1)..(9): One or more of the listed amino acids can be phosphorylated as set forth in the Tables
RPHSPEKAV

SEQ ID NO: 1699 - protein, 9 aa, Artificial Sequence
  Artificially synthesized peptide
  SITE (1)..(0): One or more of the listed amino acids can be phosphorylated as set forth in the Tables
RPHSPEKAM

SEQ ID NO: 1700 - protein, 10 aa, Artificial Sequence
  Artificially synthesized peptide
  SITE (1)..(10): One or more of the listed amino acids can be phosphorylated as set forth in the Tables
RPITPPRNSL

SEQ ID NO: 1701 - protein, 10 aa, Artificial Sequence
  Artificially synthesized peptide
  SITE (1)..(10): One or more of the listed amino acids can be phosphorylated as set forth in the Tables
RPITPPRNSV

SEQ ID NO: 1702 - protein, 10 aa, Artificial Sequence
  Artificially synthesized peptide
  SITE (1)..(10): One or more of the listed amino acids can be phosphorylated as set forth in the Tables
RPITPPRNSF

SEQ ID NO: 1703 - protein, 10 aa, Artificial Sequence
  Artificially synthesized peptide
  SITE (1)..(10): One or more of the listed amino acids can be phosphorylated as set forth in the Tables
RPITPPRNSM

SEQ ID NO: 1704 - protein, 9 aa, Artificial Sequence
  Artificially synthesized peptide
  SITE (1)..(0): One or more of the listed amino acids can be phosphorylated as set forth in the Tables
RPISPGLSL

SEQ ID NO: 1705 - protein, 9 aa, Artificial Sequence
  Artificially synthesized peptide
  SITE (1)..(0): One or more of the listed amino acids can be phosphorylated as set forth in the Tables
RPISPGLSV

SEQ ID NO: 1706 - protein, 9 aa, Artificial Sequence
  Artificially synthesized peptide
  SITE (1)..(0): One or more of the listed amino acids can be phosphorylated as set forth in the Tables
RPISPGLSF

SEQ ID NO: 1707 - protein, 9 aa, Artificial Sequence
  Artificially synthesized peptide
  SITE (1)..(0): One or more of the listed amino acids can be phosphorylated as set forth in the Tables
RPISPGLSM

SEQ ID NO: 1708 - protein, 9 aa, Artificial Sequence
  Artificially synthesized peptide
  SITE (1)..(0): One or more of the listed amino acids can be phosphorylated as set forth in the Tables
RPKLSSPAV

SEQ ID NO: 1709 - protein, 9 aa, Artificial Sequence
  Artificially synthesized peptide
  SITE (1)..(0): One or more of the listed amino acids can be phosphorylated as set forth in the Tables
RPKLSSPAF

SEQ ID NO: 1710 - protein, 9 aa, Artificial Sequence
  Artificially synthesized peptide
  SITE (1)..(0): One or more of the listed amino acids can be phosphorylated as set forth in the Tables
RPKLSSPAM

SEQ ID NO: 1711 - protein, 9 aa, Artificial Sequence
  Artificially synthesized peptide
  SITE (1)..(0): One or more of the listed amino acids can be phosphorylated as set forth in the Tables
RPKPSSSPL

SEQ ID NO: 1712 - protein, 9 aa, Artificial Sequence
  Artificially synthesized peptide
  SITE (1)..(0): One or more of the listed amino acids can be phosphorylated as set forth in the Tables
RPKPSSSPF

SEQ ID NO: 1713 - protein, 9 aa, Artificial Sequence
  Artificially synthesized peptide
  SITE (1)..(0): One or more of the listed amino acids can be phosphorylated as set forth in the Tables
RPKPSSSPM

SEQ ID NO: 1714 - protein, 10 aa, Artificial Sequence
  Artificially synthesized peptide
  SITE (1)..(10): One or more of the listed amino acids can be phosphorylated as set forth in the Tables
RPNSPSPTAV

SEQ ID NO: 1715 - protein, 10 aa, Artificial Sequence
  Artificially synthesized peptide
  SITE (1)..(10): One or more of the listed amino acids can be phosphorylated as set forth in the Tables
RPNSPSPTAF

SEQ ID NO: 1716 - protein, 10 aa, Artificial Sequence
  Artificially synthesized peptide
  SITE (1)..(10): One or more of the listed amino acids can be phosphorylated as set forth in the Tables
RPNSPSPTAM

SEQ ID NO: 1717 - protein, 10 aa, Artificial Sequence
  Artificially synthesized peptide
  SITE (1)..(10): One or more of the listed amino acids can be phosphorylated as set forth in the Tables
RPPPPPDTPL

SEQ ID NO: 1718 - protein, 10 aa, Artificial Sequence
  Artificially synthesized peptide
  SITE (1)..(10): One or more of the listed amino acids can be phosphorylated as set forth in the Tables
RPPPPPDTPV

SEQ ID NO: 1719 - protein, 10 aa, Artificial Sequence
  Artificially synthesized peptide
  SITE (1)..(10): One or more of the listed amino acids can be phosphorylated as set forth in the Tables
RPPPPPDTPF

SEQ ID NO: 1720 - protein, 10 aa, Artificial Sequence
  Artificially synthesized peptide
  SITE (1)..(10): One or more of the listed amino acids can be phosphorylated as set forth in the Tables
RPPPPPDTPM

SEQ ID NO: 1721 - protein, 9 aa, Artificial Sequence
  Artificially synthesized peptide
  SITE (1)..(0): One or more of the listed amino acids can be phosphorylated as set forth in the Tables
RPPSPGPVV

SEQ ID NO: 1722 - protein, 9 aa, Artificial Sequence
  Artificially synthesized peptide
  SITE (1)..(0): One or more of the listed amino acids can be phosphorylated as set forth in the Tables
RPPSPGPVF

SEQ ID NO: 1723 - protein, 9 aa, Artificial Sequence
  Artificially synthesized peptide
  SITE (1)..(0): One or more of the listed amino acids can be phosphorylated as set forth in the Tables
RPPSPGPVM

SEQ ID NO: 1724 - protein, 10 aa, Artificial Sequence
  Artificially synthesized peptide
  SITE (1)..(10): One or more of the listed amino acids can be phosphorylated as set forth in the Tables
RPPSSEFLDV

SEQ ID NO: 1725 - protein, 10 aa, Artificial Sequence
  Artificially synthesized peptide
  SITE (1)..(10): One or more of the listed amino acids can be phosphorylated as set forth in the Tables
RPPSSEFLDF

SEQ ID NO: 1726 - protein, 10 aa, Artificial Sequence
  Artificially synthesized peptide
  SITE (1)..(10): One or more of the listed amino acids can be phosphorylated as set forth in the Tables
RPPSSEFLDM

SEQ ID NO: 1727 - protein, 10 aa, Artificial Sequence
  Artificially synthesized peptide
  SITE (1)..(10): One or more of the listed amino acids can be phosphorylated as set forth in the Tables
RPQRATSNVV

SEQ ID NO: 1728 - protein, 10 aa, Artificial Sequence
  Artificially synthesized peptide
  SITE (1)..(10): One or more of the listed amino acids can be phosphorylated as set forth in the Tables
RPQRATSNVL

SEQ ID NO: 1729 - protein, 10 aa, Artificial Sequence
  Artificially synthesized peptide
  SITE (1)..(10): One or more of the listed amino acids can be phosphorylated as set forth in the Tables
RPQRATSNVM

SEQ ID NO: 1730 - protein, 10 aa, Artificial Sequence
  Artificially synthesized peptide
  SITE (1)..(10): One or more of the listed amino acids can be phosphorylated as set forth in the Tables
RPQRATSNVV

SEQ ID NO: 1731 - protein, 10 aa, Artificial Sequence
  Artificially synthesized peptide
  SITE (1)..(10): One or more of the listed amino acids can be phosphorylated as set forth in the Tables
RPQRATSNVL

SEQ ID NO: 1732 - protein, 10 aa, Artificial Sequence
  Artificially synthesized peptide
  SITE (1)..(10): One or more of the listed amino acids can be phosphorylated as set forth in the Tables
RPQRATSNVM

SEQ ID NO: 1733 - protein, 11 aa, Artificial Sequence
  Artificially synthesized peptide
  SITE (1)..(11): One or more of the listed amino acids can be phosphorylated as set forth in the Tables
RPRANSGGVDV

SEQ ID NO: 1734 - protein, 11 aa, Artificial Sequence
  Artificially synthesized peptide
  SITE (1)..(11): One or more of the listed amino acids can be phosphorylated as set forth in the Tables
RPRANSGGVDF

SEQ ID NO: 1735 - protein, 11 aa, Artificial Sequence
  Artificially synthesized peptide
  SITE (1)..(11): One or more of the listed amino acids can be phosphorylated as set forth in the Tables
RPRANSGGVDM

SEQ ID NO: 1736 - protein, 9 aa, Artificial Sequence
  Artificially synthesized peptide
  SITE (1)..(9): One or more of the listed amino acids can be phosphorylated as set forth in the Tables
RPRGSQSLV

SEQ ID NO: 1737 - protein, 9 aa, Artificial Sequence
  Artificially synthesized peptide
  SITE (1)..(9): One or more of the listed amino acids can be phosphorylated as set forth in the Tables
RPRGSQSLF

SEQ ID NO: 1738 - protein, 9 aa, Artificial Sequence
  Artificially synthesized peptide
  SITE (1)..(9): One or more of the listed amino acids can be phosphorylated as set forth in the Tables
RPRGSQSLM

SEQ ID NO: 1739 - protein, 10 aa, Artificial Sequence
  Artificially synthesized peptide
  SITE (1)..(10): One or more of the listed amino acids can be phosphorylated as set forth in the Tables
RPRPHSAPSV

SEQ ID NO: 1740 - protein, 10 aa, Artificial Sequence
  Artificially synthesized peptide
  SITE (1)..(10): One or more of the listed amino acids can be phosphorylated as set forth in the Tables
RPRPHSAPSF

SEQ ID NO: 1741 - protein, 10 aa, Artificial Sequence
  Artificially synthesized peptide
  SITE (1)..(10): One or more of the listed amino acids can be phosphorylated as set forth in the Tables
RPRPHSAPSM

SEQ ID NO: 1742 - protein, 10 aa, Artificial Sequence
  Artificially synthesized peptide
  SITE (1)..(10): One or more of the listed amino acids can be phosphorylated as set forth in the Tables
RPRPVSPSSV

SEQ ID NO: 1743 - protein, 10 aa, Artificial Sequence
  Artificially synthesized peptide
  SITE (1)..(10): One or more of the listed amino acids can be phosphorylated as set forth in the Tables
RPRPVSPSSF

SEQ ID NO: 1744 - protein, 10 aa, Artificial Sequence
  Artificially synthesized peptide
  SITE (1)..(10): One or more of the listed amino acids can be phosphorylated as set forth in the Tables
RPRPVSPSSM

SEQ ID NO: 1745 - protein, 9 aa, Artificial Sequence
  Artificially synthesized peptide
  SITE (1)..(9): One or more of the listed amino acids can be phosphorylated as set forth in the Tables
RPRRSSTQV

SEQ ID NO: 1746 - protein, 9 aa, Artificial Sequence
  Artificially synthesized peptide
  SITE (1)..(9): One or more of the listed amino acids can be phosphorylated as set forth in the Tables
RPRRSSTQF

SEQ ID NO: 1747 - protein, 9 aa, Artificial Sequence
  Artificially synthesized peptide
  SITE (1)..(190): One or more of the listed amino acids can be phosphorylated as set forth in the Tables
RPRRSSTQM

SEQ ID NO: 1748 - protein, 8 aa, Artificial Sequence
  Artificially synthesized peptide
  SITE (1)..(8): One or more of the listed amino acids can be phosphorylated as set forth in the Tables
RPRSAVLV

SEQ ID NO: 1749 - protein, 8 aa, Artificial Sequence
  Artificially synthesized peptide
  SITE (1)..(8): One or more of the listed amino acids can be phosphorylated as set forth in the Tables
RPRSAVLF

SEQ ID NO: 1750 - protein, 8 aa, Artificial Sequence
  Artificially synthesized peptide
  SITE (1)..(8): One or more of the listed amino acids can be phosphorylated as set forth in the Tables
RPRSAVLM

SEQ ID NO: 1751 - protein, 9 aa, Artificial Sequence
  Artificially synthesized peptide
  SITE (1)..(9): One or more of the listed amino acids can be phosphorylated as set forth in the Tables
RPRSLEVTL

SEQ ID NO: 1752 - protein, 9 aa, Artificial Sequence
  Artificially synthesized peptide
  SITE (1)..(9): One or more of the listed amino acids can be phosphorylated as set forth in the Tables
RPRSLEVTV

SEQ ID NO: 1753 - protein, 9 aa, Artificial Sequence
  Artificially synthesized peptide
  SITE (1)..(9): One or more of the listed amino acids can be phosphorylated as set forth in the Tables
RPRSLEVTF

SEQ ID NO: 1754 - protein, 9 aa, Artificial Sequence
  Artificially synthesized peptide
  SITE (1)..(9): One or more of the listed amino acids can be phosphorylated as set forth in the Tables
RPRSLEVTM

SEQ ID NO: 1755 - protein, 12 aa, Artificial Sequence
  Artificially synthesized peptide
  SITE (1)..(12): One or more of the listed amino acids can be phosphorylated as set forth in the Tables
RPRSLSSPTVTV

SEQ ID NO: 1756 - protein, 12 aa, Artificial Sequence
  Artificially synthesized peptide
  SITE (1)..(12): One or more of the listed amino acids can be phosphorylated as set forth in the Tables
RPRSLSSPTVTF

SEQ ID NO: 1757 - protein, 12 aa, Artificial Sequence
  Artificially synthesized peptide
  SITE (1)..(12): One or more of the listed amino acids can be phosphorylated as set forth in the Tables
RPRSLSSPTVTM

SEQ ID NO: 1758 - protein, 9 aa, Artificial Sequence
  Artificially synthesized peptide
  SITE (1)..(9): One or more of the listed amino acids can be phosphorylated as set forth in the Tables
RPRSPAARV

SEQ ID NO: 1759 - protein, 9 aa, Artificial Sequence
  Artificially synthesized peptide
  SITE (1)..(9): One or more of the listed amino acids can be phosphorylated as set forth in the Tables
RPRSPAARF

SEQ ID NO: 1760 - protein, 9 aa, Artificial Sequence
  Artificially synthesized peptide
  SITE (1)..(9): One or more of the listed amino acids can be phosphorylated as set forth in the Tables
RPRSPAARM

SEQ ID NO: 1761 - protein, 11 aa, Artificial Sequence
  Artificially synthesized peptide
  SITE (1)..(11): One or more of the listed amino acids can be phosphorylated as set forth in the Tables
RPRSPGSNSKV

SEQ ID NO: 1762 - protein, 11 aa, Artificial Sequence
  Artificially synthesized peptide
  SITE (1)..(11): One or more of the listed amino acids can be phosphorylated as set forth in the Tables
RPRSPGSNSKV

SEQ ID NO: 1763 - protein, 11 aa, Artificial Sequence
  Artificially synthesized peptide
  SITE (1)..(11): One or more of the listed amino acids can be phosphorylated as set forth in the Tables
RPRSPGSNSKV

SEQ ID NO: 1764 - protein, 10 aa, Artificial Sequence
  Artificially synthesized peptide
  SITE (1)..(10): One or more of the listed amino acids can be phosphorylated as set forth in the Tables
RPRSPPPRAP

SEQ ID NO: 1765 - protein, 10 aa, Artificial Sequence
  Artificially synthesized peptide
  SITE (1)..(10): One or more of the listed amino acids can be phosphorylated as set forth in the Tables
RPRSPPPRAP

SEQ ID NO: 1766 - protein, 10 aa, Artificial Sequence
  Artificially synthesized peptide
  SITE (1)..(10): One or more of the listed amino acids can be phosphorylated as set forth in the Tables
RPRSPPPRAP

SEQ ID NO: 1767 - protein, 10 aa, Artificial Sequence
  Artificially synthesized peptide
  SITE (1)..(10): One or more of the listed amino acids can be phosphorylated as set forth in the Tables
RPRSPRENSL

SEQ ID NO: 1768 - protein, 10 aa, Artificial Sequence
  Artificially synthesized peptide
  SITE (1)..(10): One or more of the listed amino acids can be phosphorylated as set forth in the Tables
RPRSPRENSV

SEQ ID NO: 1769 - protein, 10 aa, Artificial Sequence
  Artificially synthesized peptide
  SITE (1)..(10): One or more of the listed amino acids can be phosphorylated as set forth in the Tables
RPRSPRENSF

SEQ ID NO: 1770 - protein, 10 aa, Artificial Sequence
  Artificially synthesized peptide
  SITE (1)..(10): One or more of the listed amino acids can be phosphorylated as set forth in the Tables
RPRSPRENSM

SEQ ID NO: 1771 - protein, 9 aa, Artificial Sequence
  Artificially synthesized peptide
  SITE (1)..(9): One or more of the listed amino acids can be phosphorylated as set forth in the Tables
RPRSPSPIL

SEQ ID NO: 1772 - protein, 9 aa, Artificial Sequence
  Artificially synthesized peptide
  SITE (1)..(9): One or more of the listed amino acids can be phosphorylated as set forth in the Tables
RPRSPSPIV

SEQ ID NO: 1773 - protein, 9 aa, Artificial Sequence
  Artificially synthesized peptide
  SITE (1)..(9): One or more of the listed amino acids can be phosphorylated as set forth in the Tables
RPRSPSPIF

SEQ ID NO: 1774 - protein, 9 aa, Artificial Sequence
  Artificially synthesized peptide
  SITE (1)..(9): One or more of the listed amino acids can be phosphorylated as set forth in the Tables
RPRSPSPIM

SEQ ID NO: 1775 - protein, 8 aa, Artificial Sequence
  Artificially synthesized peptide
  SITE (1)..(8): One or more of the listed amino acids can be phosphorylated as set forth in the Tables
RPRSPTGL

SEQ ID NO: 1776 - protein, 8 aa, Artificial Sequence
  Artificially synthesized peptide
  SITE (1)..(8): One or more of the listed amino acids can be phosphorylated as set forth in the Tables
RPRSPTGV

SEQ ID NO: 1777 - protein, 8 aa, Artificial Sequence
  Artificially synthesized peptide
  SITE (1)..(8): One or more of the listed amino acids can be phosphorylated as set forth in the Tables
RPRSPTGF

SEQ ID NO: 1778 - protein, 8 aa, Artificial Sequence
  Artificially synthesized peptide
  SITE (1)..(8): One or more of the listed amino acids can be phosphorylated as set forth in the Tables
RPRSPTGM

SEQ ID NO: 1779 - protein, 12 aa, Artificial Sequence
  Artificially synthesized peptide
  SITE (1)..(12): One or more of the listed amino acids can be phosphorylated as set forth in the Tables
RPRSPTGPSNSL

SEQ ID NO: 1780 - protein, 12 aa, Artificial Sequence
  Artificially synthesized peptide
  SITE (1)..(12): One or more of the listed amino acids can be phosphorylated as set forth in the Tables
RPRSPTGPSNSV

SEQ ID NO: 1781 - protein, 12 aa, Artificial Sequence
  Artificially synthesized peptide
  SITE (1)..(12): One or more of the listed amino acids can be phosphorylated as set forth in the Tables
RPRSPTGPSNSM

SEQ ID NO: 1782 - protein, 10 aa, Artificial Sequence
  Artificially synthesized peptide
  SITE (1)..(10): One or more of the listed amino acids can be phosphorylated as set forth in the Tables
RPRPVSPSSV

SEQ ID NO: 1783 - protein, 10 aa, Artificial Sequence
  Artificially synthesized peptide
  SITE (1)..(10): One or more of the listed amino acids can be phosphorylated as set forth in the Tables
RPRPVSPSSF

SEQ ID NO: 1784 - protein, 10 aa, Artificial Sequence
  Artificially synthesized peptide
  SITE (1)..(10): One or more of the listed amino acids can be phosphorylated as set forth in the Tables
RPRPVSPSSM

SEQ ID NO: 1785 - protein, 9 aa, Artificial Sequence
  Artificially synthesized peptide
  SITE (1)..(9): One or more of the listed amino acids can be phosphorylated as set forth in the Tables
RPSGRRESV

SEQ ID NO: 1786 - protein, 9 aa, Artificial Sequence
  Artificially synthesized peptide
  SITE (1)..(9): One or more of the listed amino acids can be phosphorylated as set forth in the Tables
RPSGRRESF

SEQ ID NO: 1787 - protein, 9 aa, Artificial Sequence
  Artificially synthesized peptide
  SITE (1)..(9): One or more of the listed amino acids can be phosphorylated as set forth in the Tables
RPSGRRESM

SEQ ID NO: 1788 - protein, 9 aa, Artificial Sequence
  Artificially synthesized peptide
  SITE (1)..(9): One or more of the listed amino acids can be phosphorylated as set forth in the Tables
RPSRSSPGV

SEQ ID NO: 1789 - protein, 9 aa, Artificial Sequence
  Artificially synthesized peptide
  SITE (1)..(9): One or more of the listed amino acids can be phosphorylated as set forth in the Tables
RPSRSSPGF

SEQ ID NO: 1790 - protein, 9 aa, Artificial Sequence
  Artificially synthesized peptide
  SITE (1)..(9): One or more of the listed amino acids can be phosphorylated as set forth in the Tables
RPSRSSPGM

SEQ ID NO: 1791 - protein, 8 aa, Artificial Sequence
  Artificially synthesized peptide
  SITE (1)..(8): One or more of the listed amino acids can be phosphorylated as set forth in the Tables
RPSSLPDV

SEQ ID NO: 1792 - protein, 8 aa, Artificial Sequence
  Artificially synthesized peptide
  SITE (1)..(8): One or more of the listed amino acids can be phosphorylated as set forth in the Tables
RPSSLPDF

SEQ ID NO: 1793 - protein, 8 aa, Artificial Sequence
  Artificially synthesized peptide
  SITE (1)..(8): One or more of the listed amino acids can be phosphorylated as set forth in the Tables
RPSSLPDM

SEQ ID NO: 1794 - protein, 9 aa, Artificial Sequence
  Artificially synthesized peptide
  SITE (1)..(9): One or more of the listed amino acids can be phosphorylated as set forth in the Tables
RPSSPALYL

SEQ ID NO: 1795 - protein, 9 aa, Artificial Sequence
  Artificially synthesized peptide
  SITE (1)..(9): One or more of the listed amino acids can be phosphorylated as set forth in the Tables
RPSSPALYV

SEQ ID NO: 1796 - protein, 9 aa, Artificial Sequence
  Artificially synthesized peptide
  SITE (1)..(9): One or more of the listed amino acids can be phosphorylated as set forth in the Tables
RPSSPALYM

SEQ ID NO: 1797 - protein, 11 aa, Artificial Sequence
  Artificially synthesized peptide
  SITE (1)..(11): One or more of the listed amino acids can be phosphorylated as set forth in the Tables
RPSTPKSDSEV

SEQ ID NO: 1798 - protein, 11 aa, Artificial Sequence
  Artificially synthesized peptide
  SITE (1)..(11): One or more of the listed amino acids can be phosphorylated as set forth in the Tables
RPSTPKSDSEF

SEQ ID NO: 1799 - protein, 11 aa, Artificial Sequence
  Artificially synthesized peptide
  SITE (1)..(11): One or more of the listed amino acids can be phosphorylated as set forth in the Tables
RPSTPKSDSEM

SEQ ID NO: 1800 - protein, 9 aa, Artificial Sequence
  Artificially synthesized peptide
  SITE (1)..(9): One or more of the listed amino acids can be phosphorylated as set forth in the Tables
RPTSRLNRV

SEQ ID NO: 1801 - protein, 9 aa, Artificial Sequence
  Artificially synthesized peptide
  SITE (1)..(9): One or more of the listed amino acids can be phosphorylated as set forth in the Tables
RPTSRLNRF

SEQ ID NO: 1802 - protein, 9 aa, Artificial Sequence
  Artificially synthesized peptide
  SITE (1)..(9): One or more of the listed amino acids can be phosphorylated as set forth in the Tables
RPTSRLNRM

SEQ ID NO: 1803 - protein, 9 aa, Artificial Sequence
  Artificially synthesized peptide
  SITE (1)..(9): One or more of the listed amino acids can be phosphorylated as set forth in the Tables
RPVSPFQEV

SEQ ID NO: 1804 - protein, 9 aa, Artificial Sequence
  Artificially synthesized peptide
  SITE (1)..(9): One or more of the listed amino acids can be phosphorylated as set forth in the Tables
RPVSPFQEF

SEQ ID NO: 1805 - protein, 9 aa, Artificial Sequence
  Artificially synthesized peptide
  SITE (1)..(9): One or more of the listed amino acids can be phosphorylated as set forth in the Tables
RPVSPFQEM

SEQ ID NO: 1806 - protein, 9 aa, Artificial Sequence
  Artificially synthesized peptide
  SITE (1)..(9): One or more of the listed amino acids can be phosphorylated as set forth in the Tables
RPVSPGKDL

SEQ ID NO: 1807 - protein, 9 aa, Artificial Sequence
  Artificially synthesized peptide
  SITE (1)..(9): One or more of the listed amino acids can be phosphorylated as set forth in the Tables
RPVSPGKDV

SEQ ID NO: 1808 - protein, 9 aa, Artificial Sequence
  Artificially synthesized peptide
  SITE (1)..(9): One or more of the listed amino acids can be phosphorylated as set forth in the Tables
RPVSPGKDF

SEQ ID NO: 1809 - protein, 9 aa, Artificial Sequence
  Artificially synthesized peptide
  SITE (1)..(9): One or more of the listed amino acids can be phosphorylated as set forth in the Tables
RPVSPGKDM

SEQ ID NO: 1810 - protein, 9 aa, Artificial Sequence
  Artificially synthesized peptide
  SITE (1)..(9): One or more of the listed amino acids can be phosphorylated as set forth in the Tables
RPVTPVSDV

SEQ ID NO: 1811 - protein, 9 aa, Artificial Sequence
  Artificially synthesized peptide
  SITE (1)..(9): One or more of the listed amino acids can be phosphorylated as set forth in the Tables
RPVTPVSDF

SEQ ID NO: 1812 - protein, 9 aa, Artificial Sequence
  Artificially synthesized peptide
  SITE (1)..(9): One or more of the listed amino acids can be phosphorylated as set forth in the Tables
RPVTPVSDM

SEQ ID NO: 1813 - protein, 9 aa, Artificial Sequence
  Artificially synthesized peptide
  SITE (1)..(9): One or more of the listed amino acids can be phosphorylated as set forth in the Tables
RPWSPAVSL

SEQ ID NO: 1814 - protein, 9 aa, Artificial Sequence
  Artificially synthesized peptide
  SITE (1)..(9): One or more of the listed amino acids can be phosphorylated as set forth in the Tables
RPWSPAVSV

SEQ ID NO: 1815 - protein, 9 aa, Artificial Sequence
  Artificially synthesized peptide
  SITE (1)..(9): One or more of the listed amino acids can be phosphorylated as set forth in the Tables
RPWSPAVSF

SEQ ID NO: 1816 - protein, 9 aa, Artificial Sequence
  Artificially synthesized peptide
  SITE (1)..(9): One or more of the listed amino acids can be phosphorylated as set forth in the Tables
RPWSPAVSM

SEQ ID NO: 1817 - protein, 10 aa, Artificial Sequence
  Artificially synthesized peptide
  SITE (1)..(10): One or more of the listed amino acids can be phosphorylated as set forth in the Tables
RPYSPPFFSV

SEQ ID NO: 1818 - protein, 10 aa, Artificial Sequence
  Artificially synthesized peptide
  SITE (1)..(10): One or more of the listed amino acids can be phosphorylated as set forth in the Tables
RPYSPPFFSF

SEQ ID NO: 1819 - protein, 10 aa, Artificial Sequence
  Artificially synthesized peptide
  SITE (1)..(10): One or more of the listed amino acids can be phosphorylated as set forth in the Tables
RPYSPPFFSM

SEQ ID NO: 1820 - protein, 9 aa, Artificial Sequence
  Artificially synthesized peptide
  SITE (1)..(9): One or more of the listed amino acids can be phosphorylated as set forth in the Tables
RRKSQVAEV

SEQ ID NO: 1821 - protein, 9 aa, Artificial Sequence
  Artificially synthesized peptide
  SITE (1)..(9): One or more of the listed amino acids can be phosphorylated as set forth in the Tables
RRKSQVAEF

SEQ ID NO: 1822 - protein, 9 aa, Artificial Sequence
  Artificially synthesized peptide
  SITE (1)..(9): One or more of the listed amino acids can be phosphorylated as set forth in the Tables
RRKSQVAEM

SEQ ID NO: 1823 - protein, 9 aa, Artificial Sequence
  Artificially synthesized peptide
  SITE (1)..(9): One or more of the listed amino acids can be phosphorylated as set forth in the Tables
RPKSQVAEL

SEQ ID NO: 1824 - protein, 9 aa, Artificial Sequence
  Artificially synthesized peptide
  SITE (1)..(9): One or more of the listed amino acids can be phosphorylated as set forth in the Tables
RPKSQVAEV

SEQ ID NO: 1825 - protein, 9 aa, Artificial Sequence
  Artificially synthesized peptide
  SITE (1)..(9): One or more of the listed amino acids can be phosphorylated as set forth in the Tables
RPKSQVAEF

SEQ ID NO: 1826 - protein, 9 aa, Artificial Sequence
  Artificially synthesized peptide
  SITE (1)..(9): One or more of the listed amino acids can be phosphorylated as set forth in the Tables
RPKSQVAEM

SEQ ID NO: 1827 - protein, 10 aa, Artificial Sequence
  Artificially synthesized peptide
  SITE (1)..(10): One or more of the listed amino acids can be phosphorylated as set forth in the Tables
RRLSGPLHTV

SEQ ID NO: 1828 - protein, 10 aa, Artificial Sequence
  Artificially synthesized peptide
  SITE (1)..(10): One or more of the listed amino acids can be phosphorylated as set forth in the Tables
RRLSGPLHTF

SEQ ID NO: 1829 - protein, 10 aa, Artificial Sequence
  Artificially synthesized peptide
  SITE (1)..(10): One or more of the listed amino acids can be phosphorylated as set forth in the Tables
RRLSGPLHTM

SEQ ID NO: 1830 - protein, 9 aa, Artificial Sequence
  Artificially synthesized peptide
  SITE (1)..(9): One or more of the listed amino acids can be phosphorylated as set forth in the Tables
RRPSYTLGV

SEQ ID NO: 1831 - protein, 9 aa, Artificial Sequence
  Artificially synthesized peptide
  SITE (1)..(9): One or more of the listed amino acids can be phosphorylated as set forth in the Tables
RRPSYTLGL

SEQ ID NO: 1832 - protein, 9 aa, Artificial Sequence
  Artificially synthesized peptide
  SITE (1)..(9): One or more of the listed amino acids can be phosphorylated as set forth in the Tables
RRPSYTLGF

SEQ ID NO: 1833 - protein, 9 aa, Artificial Sequence
  Artificially synthesized peptide
  SITE (1)..(9): One or more of the listed amino acids can be phosphorylated as set forth in the Tables
RRSSFLQVV

SEQ ID NO: 1834 - protein, 9 aa, Artificial Sequence
  Artificially synthesized peptide
  SITE (1)..(9): One or more of the listed amino acids can be phosphorylated as set forth in the Tables
RRSSFLQLF

SEQ ID NO: 1835 - protein, 9 aa, Artificial Sequence
  Artificially synthesized peptide
  SITE (1)..(9): One or more of the listed amino acids can be phosphorylated as set forth in the Tables
RRSSFLQVM

SEQ ID NO: 1836 - protein, 12 aa, Artificial Sequence
  Artificially synthesized peptide
  SITE (1)..(12): One or more of the listed amino acids can be phosphorylated as set forth in the Tables
RRSSLDAEIDSV

SEQ ID NO: 1837 - protein, 12 aa, Artificial Sequence
  Artificially synthesized peptide
  SITE (1)..(12): One or more of the listed amino acids can be phosphorylated as set forth in the Tables
RRSSLDAEIDSF

SEQ ID NO: 1838 - protein, 12 aa, Artificial Sequence
  Artificially synthesized peptide
  SITE (1)..(12): One or more of the listed amino acids can be phosphorylated as set forth in the Tables
RRSSLDAEIDSM

SEQ ID NO: 1839 - protein, 12 aa, Artificial Sequence
  Artificially synthesized peptide
  SITE (1)..(12): One or more of the listed amino acids can be phosphorylated as set forth in the Tables
RPSSLDAEIDSL

SEQ ID NO: 1840 - protein, 12 aa, Artificial Sequence
  Artificially synthesized peptide
  SITE (1)..(12): One or more of the listed amino acids can be phosphorylated as set forth in the Tables
RPSSLDAEIDSV

SEQ ID NO: 1841 - protein, 12 aa, Artificial Sequence
  Artificially synthesized peptide
  SITE (1)..(12): One or more of the listed amino acids can be phosphorylated as set forth in the Tables
RPSSLDAEIDSF

SEQ ID NO: 1842 - protein, 12 aa, Artificial Sequence
  Artificially synthesized peptide
  SITE (1)..(12): One or more of the listed amino acids can be phosphorylated as set forth in the Tables
RPSSLDAEIDSM

SEQ ID NO: 1843 - protein, 9 aa, Artificial Sequence
  Artificially synthesized peptide
  SITE (1)..(9): One or more of the listed amino acids can be phosphorylated as set forth in the Tables
RRSSQSWSV

SEQ ID NO: 1844 - protein, 9 aa, Artificial Sequence
  Artificially synthesized peptide
  SITE (1)..(9): One or more of the listed amino acids can be phosphorylated as set forth in the Tables
RRSSQSWSF

SEQ ID NO: 1845 - protein, 9 aa, Artificial Sequence
  Artificially synthesized peptide
  SITE (1)..(9): One or more of the listed amino acids can be phosphorylated as set forth in the Tables
RRSSQSWSM

SEQ ID NO: 1846 - protein, 9 aa, Artificial Sequence
  Artificially synthesized peptide
  SITE (1)..(9): One or more of the listed amino acids can be phosphorylated as set forth in the Tables
RSESKDRKV

SEQ ID NO: 1847 - protein, 9 aa, Artificial Sequence
  Artificially synthesized peptide
  SITE (1)..(9): One or more of the listed amino acids can be phosphorylated as set forth in the Tables
RSESKDRKF

SEQ ID NO: 1848 - protein, 9 aa, Artificial Sequence
  Artificially synthesized peptide
  SITE (1)..(9): One or more of the listed amino acids can be phosphorylated as set forth in the Tables
RSESKDRKM

SEQ ID NO: 1849 - protein, 9 aa, Artificial Sequence
  Artificially synthesized peptide
  SITE (1)..(9): One or more of the listed amino acids can be phosphorylated as set forth in the Tables
RPESKDRKL

SEQ ID NO: 1850 - protein, 9 aa, Artificial Sequence
  Artificially synthesized peptide
  SITE (1)..(9): One or more of the listed amino acids can be phosphorylated as set forth in the Tables
RPESKDRKV

SEQ ID NO: 1851 - protein, 9 aa, Artificial Sequence
  Artificially synthesized peptide
  SITE (1)..(9): One or more of the listed amino acids can be phosphorylated as set forth in the Tables
RPESKDRKF

SEQ ID NO: 1852 - protein, 9 aa, Artificial Sequence
  Artificially synthesized peptide
  SITE (1)..(9): One or more of the listed amino acids can be phosphorylated as set forth in the Tables
RPESKDRKM

SEQ ID NO: 1853 - protein, 9 aa, Artificial Sequence
  Artificially synthesized peptide
  SITE (1)..(9): One or more of the listed amino acids can be phosphorylated as set forth in the Tables
RSGSLERKL

SEQ ID NO: 1854 - protein, 9 aa, Artificial Sequence
  Artificially synthesized peptide
  SITE (1)..(9): One or more of the listed amino acids can be phosphorylated as set forth in the Tables
RSGSLERKF

SEQ ID NO: 1855 - protein, 9 aa, Artificial Sequence
  Artificially synthesized peptide
  SITE (1)..(9): One or more of the listed amino acids can be phosphorylated as set forth in the Tables
RSGSLERKM

SEQ ID NO: 1856 - protein, 9 aa, Artificial Sequence
  Artificially synthesized peptide
  SITE (1)..(9): One or more of the listed amino acids can be phosphorylated as set forth in the Tables
RPGSLERKV

SEQ ID NO: 1857 - protein, 9 aa, Artificial Sequence
  Artificially synthesized peptide
  SITE (1)..(9): One or more of the listed amino acids can be phosphorylated as set forth in the Tables
RPGSLERKL

SEQ ID NO: 1858 - protein, 9 aa, Artificial Sequence
  Artificially synthesized peptide
  SITE (1)..(9): One or more of the listed amino acids can be phosphorylated as set forth in the Tables
RPGSLERKF

SEQ ID NO: 1859 - protein, 9 aa, Artificial Sequence
  Artificially synthesized peptide
  SITE (1)..(9): One or more of the listed amino acids can be phosphorylated as set forth in the Tables
RPGSLERKM

SEQ ID NO: 1860 - protein, 9 aa, Artificial Sequence
  Artificially synthesized peptide
  SITE (1)..(9): One or more of the listed amino acids can be phosphorylated as set forth in the Tables
RSLSPGGAL

SEQ ID NO: 1861 - protein, 9 aa, Artificial Sequence
  Artificially synthesized peptide
  SITE (1)..(9): One or more of the listed amino acids can be phosphorylated as set forth in the Tables
RSLSPGGAV

SEQ ID NO: 1862 - protein, 9 aa, Artificial Sequence
  Artificially synthesized peptide
  SITE (1)..(9): One or more of the listed amino acids can be phosphorylated as set forth in the Tables
RSLSPGGAF

SEQ ID NO: 1863 - protein, 9 aa, Artificial Sequence
  Artificially synthesized peptide
  SITE (1)..(9): One or more of the listed amino acids can be phosphorylated as set forth in the Tables
RSLSPGGAM

SEQ ID NO: 1864 - protein, 9 aa, Artificial Sequence
  Artificially synthesized peptide
  SITE (1)..(9): One or more of the listed amino acids can be phosphorylated as set forth in the Tables
RPLSPGGAL

SEQ ID NO: 1865 - protein, 9 aa, Artificial Sequence
  Artificially synthesized peptide
  SITE (1)..(9): One or more of the listed amino acids can be phosphorylated as set forth in the Tables
RPLSPGGAV

SEQ ID NO: 1866 - protein, 9 aa, Artificial Sequence
  Artificially synthesized peptide
  SITE (1)..(9): One or more of the listed amino acids can be phosphorylated as set forth in the Tables
RPLSPGGAF

SEQ ID NO: 1867 - protein, 9 aa, Artificial Sequence
  Artificially synthesized peptide
  SITE (1)..(9): One or more of the listed amino acids can be phosphorylated as set forth in the Tables
RPLSPGGAM

SEQ ID NO: 1868 - protein, 8 aa, Artificial Sequence
  Artificially synthesized peptide
  SITE (1)..(8): One or more of the listed amino acids can be phosphorylated as set forth in the Tables
RSLSPLLL

SEQ ID NO: 1869 - protein, 8 aa, Artificial Sequence
  Artificially synthesized peptide
  SITE (1)..(8): One or more of the listed amino acids can be phosphorylated as set forth in the Tables
RSLSPLLV

SEQ ID NO: 1870 - protein, 8 aa, Artificial Sequence
  Artificially synthesized peptide
  SITE (1)..(8): One or more of the listed amino acids can be phosphorylated as set forth in the Tables
RSLSPLLM

SEQ ID NO: 1871 - protein, 8 aa, Artificial Sequence
  Artificially synthesized peptide
  SITE (1)..(8): One or more of the listed amino acids can be phosphorylated as set forth in the Tables
RPLSPLLF

SEQ ID NO: 1872 - protein, 8 aa, Artificial Sequence
  Artificially synthesized peptide
  SITE (1)..(8): One or more of the listed amino acids can be phosphorylated as set forth in the Tables
RPLSPLLL

SEQ ID NO: 1873 - protein, 8 aa, Artificial Sequence
  Artificially synthesized peptide
  SITE (1)..(8): One or more of the listed amino acids can be phosphorylated as set forth in the Tables
RPLSPLLV

SEQ ID NO: 1874 - protein, 8 aa, Artificial Sequence
  Artificially synthesized peptide
  SITE (1)..(8): One or more of the listed amino acids can be phosphorylated as set forth in the Tables
RPLSPLLM

SEQ ID NO: 1875 - protein, 9 aa, Artificial Sequence
  Artificially synthesized peptide
  SITE (1)..(9): One or more of the listed amino acids can be phosphorylated as set forth in the Tables
RSRSPRPAV

SEQ ID NO: 1876 - protein, 9 aa, Artificial Sequence
  Artificially synthesized peptide
  SITE (1)..(9): One or more of the listed amino acids can be phosphorylated as set forth in the Tables
RSRSPRPAF

SEQ ID NO: 1877 - protein, 9 aa, Artificial Sequence
  Artificially synthesized peptide
  SITE (1)..(9): One or more of the listed amino acids can be phosphorylated as set forth in the Tables
RSRSPRPAM

SEQ ID NO: 1878 - protein, 10 aa, Artificial Sequence
  Artificially synthesized peptide
  SITE (1)..(10): One or more of the listed amino acids can be phosphorylated as set forth in the Tables
RTESDSGLKL

SEQ ID NO: 1879 - protein, 10 aa, Artificial Sequence
  Artificially synthesized peptide
  SITE (1)..(10): One or more of the listed amino acids can be phosphorylated as set forth in the Tables
RTESDSGLKV

SEQ ID NO: 1880 - protein, 10 aa, Artificial Sequence
  Artificially synthesized peptide
  SITE (1)..(10): One or more of the listed amino acids can be phosphorylated as set forth in the Tables
RTESDSGLKF

SEQ ID NO: 1881 - protein, 10 aa, Artificial Sequence
  Artificially synthesized peptide
  SITE (1)..(10): One or more of the listed amino acids can be phosphorylated as set forth in the Tables
RTESDSGLKM

SEQ ID NO: 1882 - protein, 10 aa, Artificial Sequence
  Artificially synthesized peptide
  SITE (1)..(10): One or more of the listed amino acids can be phosphorylated as set forth in the Tables
RPESDSGLKL

SEQ ID NO: 1883 - protein, 10 aa, Artificial Sequence
  Artificially synthesized peptide
  SITE (1)..(10): One or more of the listed amino acids can be phosphorylated as set forth in the Tables
RPESDSGLKV

SEQ ID NO: 1884 - protein, 10 aa, Artificial Sequence
  Artificially synthesized peptide
  SITE (1)..(10): One or more of the listed amino acids can be phosphorylated as set forth in the Tables
RPESDSGLKF

SEQ ID NO: 1885 - protein, 10 aa, Artificial Sequence
  Artificially synthesized peptide
  SITE (1)..(10): One or more of the listed amino acids can be phosphorylated as set forth in the Tables
RPESDSGLKM

SEQ ID NO: 1886 - protein, 9 aa, Artificial Sequence
  Artificially synthesized peptide
  SITE (1)..(9): One or more of the listed amino acids can be phosphorylated as set forth in the Tables
RTFSPTYGV

SEQ ID NO: 1887 - protein, 9 aa, Artificial Sequence
  Artificially synthesized peptide
  SITE (1)..(9): One or more of the listed amino acids can be phosphorylated as set forth in the Tables
RTFSPTYGF

SEQ ID NO: 1888 - protein, 9 aa, Artificial Sequence
  Artificially synthesized peptide
  SITE (1)..(9): One or more of the listed amino acids can be phosphorylated as set forth in the Tables
RTFSPTYGM

SEQ ID NO: 1889 - protein, 9 aa, Artificial Sequence
  Artificially synthesized peptide
  SITE (1)..(9): One or more of the listed amino acids can be phosphorylated as set forth in the Tables
RTRSPSPTV

SEQ ID NO: 1890 - protein, 9 aa, Artificial Sequence
  Artificially synthesized peptide
  SITE (1)..(9): One or more of the listed amino acids can be phosphorylated as set forth in the Tables
RTRSPSPTF

SEQ ID NO: 1891 - protein, 9 aa, Artificial Sequence
  Artificially synthesized peptide
  SITE (1)..(9): One or more of the listed amino acids can be phosphorylated as set forth in the Tables
RTRSPSPTM

SEQ ID NO: 1892 - protein, 9 aa, Artificial Sequence
  Artificially synthesized peptide
  SITE (1)..(9): One or more of the listed amino acids can be phosphorylated as set forth in the Tables
RVRSPTRSL

SEQ ID NO: 1893 - protein, 9 aa, Artificial Sequence
  Artificially synthesized peptide
  SITE (1)..(9): One or more of the listed amino acids can be phosphorylated as set forth in the Tables
RVRSPTRSV

SEQ ID NO: 1894 - protein, 9 aa, Artificial Sequence
  Artificially synthesized peptide
  SITE (1)..(9): One or more of the listed amino acids can be phosphorylated as set forth in the Tables
RVRSPTRSF

SEQ ID NO: 1895 - protein, 9 aa, Artificial Sequence
  Artificially synthesized peptide
  SITE (1)..(9): One or more of the listed amino acids can be phosphorylated as set forth in the Tables
RVRSPTRSM

SEQ ID NO: 1896 - protein, 9 aa, Artificial Sequence
  Artificially synthesized peptide
  SITE (1)..(9): One or more of the listed amino acids can be phosphorylated as set forth in the Tables
RPRSPTRSL

SEQ ID NO: 1897 - protein, 9 aa, Artificial Sequence
  Artificially synthesized peptide
  SITE (1)..(9): One or more of the listed amino acids can be phosphorylated as set forth in the Tables
RPRSPTRSV

SEQ ID NO: 1898 - protein, 9 aa, Artificial Sequence
  Artificially synthesized peptide
  SITE (1)..(9): One or more of the listed amino acids can be phosphorylated as set forth in the Tables
RPRSPTRSF

SEQ ID NO: 1899 - protein, 9 aa, Artificial Sequence
  Artificially synthesized peptide
  SITE (1)..(9): One or more of the listed amino acids can be phosphorylated as set forth in the Tables
RPRSPTRSM

SEQ ID NO: 1900 - protein, 9 aa, Artificial Sequence
  Artificially synthesized peptide
  SITE (1)..(9): One or more of the listed amino acids can be phosphorylated as set forth in the Tables
SPASPKISV

SEQ ID NO: 1901 - protein, 9 aa, Artificial Sequence
  Artificially synthesized peptide
  SITE (1)..(9): One or more of the listed amino acids can be phosphorylated as set forth in the Tables
SPASPKISF

SEQ ID NO: 1902 - protein, 9 aa, Artificial Sequence
  Artificially synthesized peptide
  SITE (1)..(9): One or more of the listed amino acids can be phosphorylated as set forth in the Tables
SPASPKISM

SEQ ID NO: 1903 - protein, 11 aa, Artificial Sequence
  Artificially synthesized peptide
  SITE (1)..(11): One or more of the listed amino acids can be phosphorylated as set forth in the Tables
SPEKAGRRSSV

SEQ ID NO: 1904 - protein, 11 aa, Artificial Sequence
  Artificially synthesized peptide
  SITE (1)..(11): One or more of the listed amino acids can be phosphorylated as set forth in the Tables
SPEKAGRRSSF

SEQ ID NO: 1905 - protein, 11 aa, Artificial Sequence
  Artificially synthesized peptide
  SITE (1)..(11): One or more of the listed amino acids can be phosphorylated as set forth in the Tables
SPEKAGRRSSM

SEQ ID NO: 1906 - protein, 9 aa, Artificial Sequence
  Artificially synthesized peptide
  SITE (1)..(9): One or more of the listed amino acids can be phosphorylated as set forth in the Tables
SPFKRQLSV

SEQ ID NO: 1907 - protein, 9 aa, Artificial Sequence
  Artificially synthesized peptide
  SITE (1)..(9): One or more of the listed amino acids can be phosphorylated as set forth in the Tables
SPFKRQLSF

SEQ ID NO: 1908 - protein, 9 aa, Artificial Sequence
  Artificially synthesized peptide
  SITE (1)..(9): One or more of the listed amino acids can be phosphorylated as set forth in the Tables
SPFKRQLSM

SEQ ID NO: 1909 - protein, 10 aa, Artificial Sequence
  Artificially synthesized peptide
  SITE (1)..(10): One or more of the listed amino acids can be phosphorylated as set forth in the Tables
SPGLARKRSV

SEQ ID NO: 1910 - protein, 10 aa, Artificial Sequence
  Artificially synthesized peptide
  SITE (1)..(10): One or more of the listed amino acids can be phosphorylated as set forth in the Tables
SPGLARKRSF

SEQ ID NO: 1911 - protein, 10 aa, Artificial Sequence
  Artificially synthesized peptide
  SITE (1)..(10): One or more of the listed amino acids can be phosphorylated as set forth in the Tables
SPGLARKRSM

SEQ ID NO: 1912 - protein, 9 aa, Artificial Sequence
  Artificially synthesized peptide
  SITE (1)..(9): One or more of the listed amino acids can be phosphorylated as set forth in the Tables
SPKSPGLKL

SEQ ID NO: 1913 - protein, 9 aa, Artificial Sequence
  Artificially synthesized peptide
  SITE (1)..(9): One or more of the listed amino acids can be phosphorylated as set forth in the Tables
SPKSPGLKV

SEQ ID NO: 1914 - protein, 9 aa, Artificial Sequence
  Artificially synthesized peptide
  SITE (1)..(9): One or more of the listed amino acids can be phosphorylated as set forth in the Tables
SPKSPGLKF

SEQ ID NO: 1915 - protein, 9 aa, Artificial Sequence
  Artificially synthesized peptide
  SITE (1)..(9): One or more of the listed amino acids can be phosphorylated as set forth in the Tables
SPKSPGLKM

SEQ ID NO: 1916 - protein, 9 aa, Artificial Sequence
  Artificially synthesized peptide
  SITE (1)..(9): One or more of the listed amino acids can be phosphorylated as set forth in the Tables
SPKSPTAAV

SEQ ID NO: 1917 - protein, 9 aa, Artificial Sequence
  Artificially synthesized peptide
  SITE (1)..(9): One or more of the listed amino acids can be phosphorylated as set forth in the Tables
SPKSPTAAF

SEQ ID NO: 1918 - protein, 9 aa, Artificial Sequence
  Artificially synthesized peptide
  SITE (1)..(9): One or more of the listed amino acids can be phosphorylated as set forth in the Tables
SPKSPTAAM

SEQ ID NO: 1919 - protein, 9 aa, Artificial Sequence
  Artificially synthesized peptide
  SITE (1)..(9): One or more of the listed amino acids can be phosphorylated as set forth in the Tables
SPRERSPAL

SEQ ID NO: 1920 - protein, 9 aa, Artificial Sequence
  Artificially synthesized peptide
  SITE (1)..(9): One or more of the listed amino acids can be phosphorylated as set forth in the Tables
SPRERSPAL

SEQ ID NO: 1921 - protein, 9 aa, Artificial Sequence
  Artificially synthesized peptide
  SITE (1)..(9): One or more of the listed amino acids can be phosphorylated as set forth in the Tables
SPRERSPAL

SEQ ID NO: 1922 - protein, 10 aa, Artificial Sequence
  Artificially synthesized peptide
  SITE (1)..(10): One or more of the listed amino acids can be phosphorylated as set forth in the Tables
SPRRSRSISV

SEQ ID NO: 1923 - protein, 10 aa, Artificial Sequence
  Artificially synthesized peptide
  SITE (1)..(10): One or more of the listed amino acids can be phosphorylated as set forth in the Tables
SPRRSRSISF

SEQ ID NO: 1924 - protein, 10 aa, Artificial Sequence
  Artificially synthesized peptide
  SITE (1)..(10): One or more of the listed amino acids can be phosphorylated as set forth in the Tables
SPRRSRSISM

SEQ ID NO: 1925 - protein, 10 aa, Artificial Sequence
  Artificially synthesized peptide
  SITE (1)..(10): One or more of the listed amino acids can be phosphorylated as set forth in the Tables
SPRRSRSISV

SEQ ID NO: 1926 - protein, 10 aa, Artificial Sequence
  Artificially synthesized peptide
  SITE (1)..(10): One or more of the listed amino acids can be phosphorylated as set forth in the Tables
SPRRSRSISF

SEQ ID NO: 1927 - protein, 10 aa, Artificial Sequence
  Artificially synthesized peptide
  SITE (1)..(10): One or more of the listed amino acids can be phosphorylated as set forth in the Tables
SPRRSRSISM

SEQ ID NO: 1928 - protein, 9 aa, Artificial Sequence
  Artificially synthesized peptide
  SITE (1)..(9): One or more of the listed amino acids can be phosphorylated as set forth in the Tables
SPRSITSTV

SEQ ID NO: 1929 - protein, 9 aa, Artificial Sequence
  Artificially synthesized peptide
  SITE (1)..(9): One or more of the listed amino acids can be phosphorylated as set forth in the Tables
SPRSITSTL

SEQ ID NO: 1930 - protein, 9 aa, Artificial Sequence
  Artificially synthesized peptide
  SITE (1)..(9): One or more of the listed amino acids can be phosphorylated as set forth in the Tables
SPRSITSTF

SEQ ID NO: 1931 - protein, 9 aa, Artificial Sequence
  Artificially synthesized peptide
  SITE (1)..(9): One or more of the listed amino acids can be phosphorylated as set forth in the Tables
SPRSITSTM

SEQ ID NO: 1932 - protein, 9 aa, Artificial Sequence
  Artificially synthesized peptide
  SITE (1)..(9): One or more of the listed amino acids can be phosphorylated as set forth in the Tables
SPRSPGKPL

SEQ ID NO: 1933 - protein, 9 aa, Artificial Sequence
  Artificially synthesized peptide
  SITE (1)..(9): One or more of the listed amino acids can be phosphorylated as set forth in the Tables
SPRSPGKPV

SEQ ID NO: 1934 - protein, 9 aa, Artificial Sequence
  Artificially synthesized peptide
  SITE (1)..(9): One or more of the listed amino acids can be phosphorylated as set forth in the Tables
SPRSPGKPF

SEQ ID NO: 1935 - protein, 9 aa, Artificial Sequence
  Artificially synthesized peptide
  SITE (1)..(9): One or more of the listed amino acids can be phosphorylated as set forth in the Tables
SPRSPGRSV

SEQ ID NO: 1936 - protein, 9 aa, Artificial Sequence
  Artificially synthesized peptide
  SITE (1)..(9): One or more of the listed amino acids can be phosphorylated as set forth in the Tables
SPRSPGRSF

SEQ ID NO: 1937 - protein, 9 aa, Artificial Sequence
  Artificially synthesized peptide
  SITE (1)..(9): One or more of the listed amino acids can be phosphorylated as set forth in the Tables
SPRSPGRSM

SEQ ID NO: 1938 - protein, 10 aa, Artificial Sequence
  Artificially synthesized peptide
  SITE (1)..(10): One or more of the listed amino acids can be phosphorylated as set forth in the Tables
SPRSPSTTYV

SEQ ID NO: 1939 - protein, 10 aa, Artificial Sequence
  Artificially synthesized peptide
  SITE (1)..(10): One or more of the listed amino acids can be phosphorylated as set forth in the Tables
SPRSPSTTYF

SEQ ID NO: 1940 - protein, 10 aa, Artificial Sequence
  Artificially synthesized peptide
  SITE (1)..(10): One or more of the listed amino acids can be phosphorylated as set forth in the Tables
SPRSPSTTYM

SEQ ID NO: 1941 - protein, 11 aa, Artificial Sequence
  Artificially synthesized peptide
  SITE (1)..(11): One or more of the listed amino acids can be phosphorylated as set forth in the Tables
SPRTPVSPVKL

SEQ ID NO: 1942 - protein, 11 aa, Artificial Sequence
  Artificially synthesized peptide
  SITE (1)..(11): One or more of the listed amino acids can be phosphorylated as set forth in the Tables
SPRTPVSPVKV

SEQ ID NO: 1943 - protein, 11 aa, Artificial Sequence
  Artificially synthesized peptide
  SITE (1)..(11): One or more of the listed amino acids can be phosphorylated as set forth in the Tables
SPRTPVSPVKM

SEQ ID NO: 1944 - protein, 11 aa, Artificial Sequence
  Artificially synthesized peptide
  SITE (1)..(11): One or more of the listed amino acids can be phosphorylated as set forth in the Tables
SPRTPVSPVKL

SEQ ID NO: 1945 - protein, 11 aa, Artificial Sequence
  Artificially synthesized peptide
  SITE (1)..(11): One or more of the listed amino acids can be phosphorylated as set forth in the Tables
SPRTPVSPVKV

SEQ ID NO: 1946 - protein, 11 aa, Artificial Sequence
  Artificially synthesized peptide
  SITE (1)..(11): One or more of the listed amino acids can be phosphorylated as set forth in the Tables
SPRTPVSPVKM

SEQ ID NO: 1947 - protein, 11 aa, Artificial Sequence
  Artificially synthesized peptide
  SITE (1)..(11): One or more of the listed amino acids can be phosphorylated as set forth in the Tables
SPSSPSVRRQV

SEQ ID NO: 1948 - protein, 11 aa, Artificial Sequence
  Artificially synthesized peptide
  SITE (1)..(11): One or more of the listed amino acids can be phosphorylated as set forth in the Tables
SPSSPSVRRQF

SEQ ID NO: 1949 - protein, 11 aa, Artificial Sequence
  Artificially synthesized peptide
  SITE (1)..(11): One or more of the listed amino acids can be phosphorylated as set forth in the Tables
SPSSPSVRRQM

SEQ ID NO: 1950 - protein, 13 aa, Artificial Sequence
  Artificially synthesized peptide
  SITE (1)..(13): One or more of the listed amino acids can be phosphorylated as set forth in the Tables
SPSTSRSGGSSRV

SEQ ID NO: 1951 - protein, 13 aa, Artificial Sequence
  Artificially synthesized peptide
  SITE (1)..(13): One or more of the listed amino acids can be phosphorylated as set forth in the Tables
SPSTSRSGGSSRF

SEQ ID NO: 1952 - protein, 13 aa, Artificial Sequence
  Artificially synthesized peptide
  SITE (1)..(13): One or more of the listed amino acids can be phosphorylated as set forth in the Tables
SPSTSRSGGSSRM

SEQ ID NO: 1953 - protein, 8 aa, Artificial Sequence
  Artificially synthesized peptide
  SITE (1)..(8): One or more of the listed amino acids can be phosphorylated as set forth in the Tables
SPVVHQSV

SEQ ID NO: 1954 - protein, 8 aa, Artificial Sequence
  Artificially synthesized peptide
  SITE (1)..(8): One or more of the listed amino acids can be phosphorylated as set forth in the Tables
SPVVHQSF

SEQ ID NO: 1955 - protein, 8 aa, Artificial Sequence
  Artificially synthesized peptide
  SITE (1)..(8): One or more of the listed amino acids can be phosphorylated as set forth in the Tables
SPVVHQSM

SEQ ID NO: 1956 - protein, 10 aa, Artificial Sequence
  Artificially synthesized peptide
  SITE (1)..(10): One or more of the listed amino acids can be phosphorylated as set forth in the Tables
TPAQPQRRSV

SEQ ID NO: 1957 - protein, 10 aa, Artificial Sequence
  Artificially synthesized peptide
  SITE (1)..(10): One or more of the listed amino acids can be phosphorylated as set forth in the Tables
TPAQPQRRSF

SEQ ID NO: 1958 - protein, 10 aa, Artificial Sequence
  Artificially synthesized peptide
  SITE (1)..(10): One or more of the listed amino acids can be phosphorylated as set forth in the Tables
TPAQPQRRSM

SEQ ID NO: 1959 - protein, 11 aa, Artificial Sequence
  Artificially synthesized peptide
  SITE (1)..(11): One or more of the listed amino acids can be phosphorylated as set forth in the Tables
TPISPGRASGF

SEQ ID NO: 1960 - protein, 11 aa, Artificial Sequence
  Artificially synthesized peptide
  SITE (1)..(11): One or more of the listed amino acids can be phosphorylated as set forth in the Tables
TPISPGRASGV

SEQ ID NO: 1961 - protein, 11 aa, Artificial Sequence
  Artificially synthesized peptide
  SITE (1)..(11): One or more of the listed amino acids can be phosphorylated as set forth in the Tables
TPISPGRASGL

SEQ ID NO: 1962 - protein, 9 aa, Artificial Sequence
  Artificially synthesized peptide
  SITE (1)..(9): One or more of the listed amino acids can be phosphorylated as set forth in the Tables
TPRSPPLGV

SEQ ID NO: 1963 - protein, 9 aa, Artificial Sequence
  Artificially synthesized peptide
  SITE (1)..(9): One or more of the listed amino acids can be phosphorylated as set forth in the Tables
TPRSPPLGF

SEQ ID NO: 1964 - protein, 9 aa, Artificial Sequence
  Artificially synthesized peptide
  SITE (1)..(9): One or more of the listed amino acids can be phosphorylated as set forth in the Tables
TPRSPPLGM

SEQ ID NO: 1965 - protein, 10 aa, Artificial Sequence
  Artificially synthesized peptide
  SITE (1)..(10): One or more of the listed amino acids can be phosphorylated as set forth in the Tables
TPRSPPLGLL

SEQ ID NO: 1966 - protein, 10 aa, Artificial Sequence
  Artificially synthesized peptide
  SITE (1)..(10): One or more of the listed amino acids can be phosphorylated as set forth in the Tables
TPRSPPLGLV

SEQ ID NO: 1967 - protein, 10 aa, Artificial Sequence
  Artificially synthesized peptide
  SITE (1)..(10): One or more of the listed amino acids can be phosphorylated as set forth in the Tables
TPRSPPLGLF

SEQ ID NO: 1968 - protein, 10 aa, Artificial Sequence
  Artificially synthesized peptide
  SITE (1)..(10): One or more of the listed amino acids can be phosphorylated as set forth in the Tables
TPRSPPLGLM

SEQ ID NO: 1969 - protein, 13 aa, Artificial Sequence
  Artificially synthesized peptide
  SITE (1)..(13): One or more of the listed amino acids can be phosphorylated as set forth in the Tables
VPRSPKHAHSSSV

SEQ ID NO: 1970 - protein, 13 aa, Artificial Sequence
  Artificially synthesized peptide
  SITE (1)..(13): One or more of the listed amino acids can be phosphorylated as set forth in the Tables
VPRSPKHAHSSSF

SEQ ID NO: 1971 - protein, 13 aa, Artificial Sequence
  Artificially synthesized peptide
  SITE (1)..(13): One or more of the listed amino acids can be phosphorylated as set forth in the Tables
VPRSPKHAHSSSM

SEQ ID NO: 1972 - protein, 8 aa, Artificial Sequence
  Artificially synthesized peptide
  SITE (1)..(8): One or more of the listed amino acids can be phosphorylated as set forth in the Tables
YPSSPRKV

SEQ ID NO: 1973 - protein, 8 aa, Artificial Sequence
  Artificially synthesized peptide
  SITE (1)..(8): One or more of the listed amino acids can be phosphorylated as set forth in the Tables
YPSSPRKF

SEQ ID NO: 1974 - protein, 8 aa, Artificial Sequence
  Artificially synthesized peptide
  SITE (1)..(8): One or more of the listed amino acids can be phosphorylated as set forth in the Tables
YPSSPRKM

SEQ ID NO: 1975 - protein, 11 aa, Artificial Sequence
  Artificially synthesized peptide
  SITE (1)..(11): One or more of the listed amino acids can be phosphorylated as set forth in the Tables
YQRSFDEVEGL

SEQ ID NO: 1976 - protein, 11 aa, Artificial Sequence
  Artificially synthesized peptide
  SITE (1)..(11): One or more of the listed amino acids can be phosphorylated as set forth in the Tables
YQRSFDEVEGF

SEQ ID NO: 1977 - protein, 11 aa, Artificial Sequence
  Artificially synthesized peptide
  SITE (1)..(11): One or more of the listed amino acids can be phosphorylated as set forth in the Tables
YQRSFDEVEGM

SEQ ID NO: 1978 - protein, 11 aa, Artificial Sequence
  Artificially synthesized peptide
  SITE (1)..(11): One or more of the listed amino acids can be phosphorylated as set forth in the Tables
YPRSFDEVEGV

SEQ ID NO: 1979 - protein, 11 aa, Artificial Sequence
  Artificially synthesized peptide
  SITE (1)..(11): One or more of the listed amino acids can be phosphorylated as set forth in the Tables
YPRSFDEVEGL

SEQ ID NO: 1980 - protein, 11 aa, Artificial Sequence
  Artificially synthesized peptide
  SITE (1)..(11): One or more of the listed amino acids can be phosphorylated as set forth in the Tables
YPRSFDEVEGF

SEQ ID NO: 1981 - protein, 11 aa, Artificial Sequence
  Artificially synthesized peptide
  SITE (1)..(11): One or more of the listed amino acids can be phosphorylated as set forth in the Tables
YPRSFDEVEGM

SEQ ID NO: 1982 - protein, 12 aa, Artificial Sequence
  Artificially synthesized peptide
  SITE (1)..(12): One or more of the listed amino acids can be phosphorylated as set forth in the Tables
YQRSFDEVEGVL

SEQ ID NO: 1983 - protein, 12 aa, Artificial Sequence
  Artificially synthesized peptide
  SITE (1)..(12): One or more of the listed amino acids can be phosphorylated as set forth in the Tables
YQRSFDEVEGVV

SEQ ID NO: 1984 - protein, 12 aa, Artificial Sequence
  Artificially synthesized peptide
  SITE (1)..(12): One or more of the listed amino acids can be phosphorylated as set forth in the Tables
YQRSFDEVEGVM

SEQ ID NO: 1985 - protein, 12 aa, Artificial Sequence
  Artificially synthesized peptide
  SITE (1)..(12): One or more of the listed amino acids can be phosphorylated as set forth in the Tables
YPRSFDEVEGVF

SEQ ID NO: 1986 - protein, 12 aa, Artificial Sequence
  Artificially synthesized peptide
  SITE (1)..(12): One or more of the listed amino acids can be phosphorylated as set forth in the Tables
YPRSFDEVEGVL

SEQ ID NO: 1987 - protein, 12 aa, Artificial Sequence
  Artificially synthesized peptide
  SITE (1)..(12): One or more of the listed amino acids can be phosphorylated as set forth in the Tables
YPRSFDEVEGVV

SEQ ID NO: 1988 - protein, 12 aa, Artificial Sequence
  Artificially synthesized peptide
  SITE (1)..(12): One or more of the listed amino acids can be phosphorylated as set forth in the Tables
YPRSFDEVEGVM

SEQ ID NO: 1989 - protein, 10 aa, Artificial Sequence
  Artificially synthesized peptide
  SITE (1)..(10): One or more of the listed amino acids can be phosphorylated as set forth in the Tables
ALYSPAQPSV

SEQ ID NO: 1990 - protein, 9 aa, Artificial Sequence
  Artificially synthesized peptide
  SITE (1)..(9): One or more of the listed amino acids can be phosphorylated as set forth in the Tables
ALAASPHAV

SEQ ID NO: 1991 - protein, 11 aa, Artificial Sequence
  Artificially synthesized peptide
  SITE (1)..(11): One or more of the listed amino acids can be phosphorylated as set forth in the Tables
AVVSPPALHNV

SEQ ID NO: 1992 - protein, 11 aa, Artificial Sequence
  Artificially synthesized peptide
  SITE (1)..(11): One or more of the listed amino acids can be phosphorylated as set forth in the Tables
ALVSPPALHNV

SEQ ID NO: 1993 - protein, 11 aa, Artificial Sequence
  Artificially synthesized peptide
  SITE (1)..(11): One or more of the listed amino acids can be phosphorylated as set forth in the Tables
ALVSPPALHNA

SEQ ID NO: 1994 - protein, 11 aa, Artificial Sequence
  Artificially synthesized peptide
  SITE (1)..(11): One or more of the listed amino acids can be phosphorylated as set forth in the Tables
AMVSPPALHNA

SEQ ID NO: 1995 - protein, 11 aa, Artificial Sequence
  Artificially synthesized peptide
  SITE (1)..(11): One or more of the listed amino acids can be phosphorylated as set forth in the Tables
AMVSPPALHNV

SEQ ID NO: 1996 - protein, 9 aa, Artificial Sequence
  Artificially synthesized peptide
  SITE (1)..(9): One or more of the listed amino acids can be phosphorylated as set forth in the Tables
GMLGSPVRV

SEQ ID NO: 1997 - protein, 10 aa, Artificial Sequence
  Artificially synthesized peptide
  SITE (1)..(10): One or more of the listed amino acids can be phosphorylated as set forth in the Tables
ILKSPEIQRV

SEQ ID NO: 1998 - protein, 10 aa, Artificial Sequence
  Artificially synthesized peptide
  SITE (1)..(10): One or more of the listed amino acids can be phosphorylated as set forth in the Tables
IMKSPEIQRV

SEQ ID NO: 1999 - protein, 10 aa, Artificial Sequence
  Artificially synthesized peptide
  SITE (1)..(10): One or more of the listed amino acids can be phosphorylated as set forth in the Tables
IMKSPEIQRA

SEQ ID NO: 2000 - protein, 9 aa, Artificial Sequence
  Artificially synthesized peptide
  SITE (1)..(9): One or more of the listed amino acids can be phosphorylated as set forth in the Tables
ILDRTPEKL

SEQ ID NO: 2001 - protein, 9 aa, Artificial Sequence
  Artificially synthesized peptide
  SITE (1)..(9): One or more of the listed amino acids can be phosphorylated as set forth in the Tables
IMDRTPEKV

SEQ ID NO: 2002 - protein, 9 aa, Artificial Sequence
  Artificially synthesized peptide
  SITE (1)..(9): One or more of the listed amino acids can be phosphorylated as set forth in the Tables
ILDRTPEKV

SEQ ID NO: 2003 - protein, 10 aa, Artificial Sequence
  Artificially synthesized peptide
  SITE (1)..(10): One or more of the listed amino acids can be phosphorylated as set forth in the Tables
KMASPELERL

SEQ ID NO: 2004 - protein, 10 aa, Artificial Sequence
  Artificially synthesized peptide
  SITE (1)..(10): One or more of the listed amino acids can be phosphorylated as set forth in the Tables
KLASPELERV

SEQ ID NO: 2005 - protein, 10 aa, Artificial Sequence
  Artificially synthesized peptide
  SITE (1)..(10): One or more of the listed amino acids can be phosphorylated as set forth in the Tables
KMASPELERV

SEQ ID NO: 2006 - protein, 10 aa, Artificial Sequence
  Artificially synthesized peptide
  SITE (1)..(10): One or more of the listed amino acids can be phosphorylated as set forth in the Tables
KMFPDTPLAL

SEQ ID NO: 2007 - protein, 10 aa, Artificial Sequence
  Artificially synthesized peptide
  SITE (1)..(10): One or more of the listed amino acids can be phosphorylated as set forth in the Tables
KLFPDTPLAV

SEQ ID NO: 2008 - protein, 10 aa, Artificial Sequence
  Artificially synthesized peptide
  SITE (1)..(10): One or more of the listed amino acids can be phosphorylated as set forth in the Tables
KMFPDTPLAV

SEQ ID NO: 2009 - protein, 11 aa, Artificial Sequence
  Artificially synthesized peptide
  SITE (1)..(11): One or more of the listed amino acids can be phosphorylated as set forth in the Tables
KMIDIVSSQKV

SEQ ID NO: 2010 - protein, 13 aa, Artificial Sequence
  Artificially synthesized peptide
  SITE (1)..(13): One or more of the listed amino acids can be phosphorylated as set forth in the Tables
KMLDFGSLSNLQV

SEQ ID NO: 2011 - protein, 10 aa, Artificial Sequence
  Artificially synthesized peptide
  SITE (1)..(10): One or more of the listed amino acids can be phosphorylated as set forth in the Tables
KMLSPSNEKL

SEQ ID NO: 2012 - protein, 10 aa, Artificial Sequence
  Artificially synthesized peptide
  SITE (1)..(10): One or more of the listed amino acids can be phosphorylated as set forth in the Tables
KLLSPSNEKV

SEQ ID NO: 2013 - protein, 10 aa, Artificial Sequence
  Artificially synthesized peptide
  SITE (1)..(10): One or more of the listed amino acids can be phosphorylated as set forth in the Tables
KMLSPSNEKV

SEQ ID NO: 2014 - protein, 10 aa, Artificial Sequence
  Artificially synthesized peptide
  SITE (1)..(10): One or more of the listed amino acids can be phosphorylated as set forth in the Tables
KMLSSAQRTL

SEQ ID NO: 2015 - protein, 10 aa, Artificial Sequence
  Artificially synthesized peptide
  SITE (1)..(10): One or more of the listed amino acids can be phosphorylated as set forth in the Tables
KLLSSAQRTV

SEQ ID NO: 2016 - protein, 10 aa, Artificial Sequence
  Artificially synthesized peptide
  SITE (1)..(10): One or more of the listed amino acids can be phosphorylated as set forth in the Tables
KMLSSAQRTV

SEQ ID NO: 2017 - protein, 11 aa, Artificial Sequence
  Artificially synthesized peptide
  SITE (1)..(11): One or more of the listed amino acids can be phosphorylated as set forth in the Tables
KMMSPKADVKL

SEQ ID NO: 2018 - protein, 11 aa, Artificial Sequence
  Artificially synthesized peptide
  SITE (1)..(11): One or more of the listed amino acids can be phosphorylated as set forth in the Tables
KLMSPKADVKV

SEQ ID NO: 2019 - protein, 11 aa, Artificial Sequence
  Artificially synthesized peptide
  SITE (1)..(11): One or more of the listed amino acids can be phosphorylated as set forth in the Tables
KMMSPKADVKV

SEQ ID NO: 2020 - protein, 9 aa, Artificial Sequence
  Artificially synthesized peptide
  SITE (1)..(9): One or more of the listed amino acids can be phosphorylated as set forth in the Tables
KLQVTSLSV

SEQ ID NO: 2021 - protein, 9 aa, Artificial Sequence
  Artificially synthesized peptide
  SITE (1)..(9): One or more of the listed amino acids can be phosphorylated as set forth in the Tables
LLFSPVTSL

SEQ ID NO: 2022 - protein, 9 aa, Artificial Sequence
  Artificially synthesized peptide
  SITE (1)..(9): One or more of the listed amino acids can be phosphorylated as set forth in the Tables
LMFSPVTSV

SEQ ID NO: 2023 - protein, 9 aa, Artificial Sequence
  Artificially synthesized peptide
  SITE (1)..(9): One or more of the listed amino acids can be phosphorylated as set forth in the Tables
LLFSPVTSV

SEQ ID NO: 2024 - protein, 9 aa, Artificial Sequence
  Artificially synthesized peptide
  SITE (1)..(9): One or more of the listed amino acids can be phosphorylated as set forth in the Tables
RMDSYVRSL

SEQ ID NO: 2025 - protein, 9 aa, Artificial Sequence
  Artificially synthesized peptide
  SITE (1)..(9): One or more of the listed amino acids can be phosphorylated as set forth in the Tables
RLDSYVRSV

SEQ ID NO: 2026 - protein, 9 aa, Artificial Sequence
  Artificially synthesized peptide
  SITE (1)..(9): One or more of the listed amino acids can be phosphorylated as set forth in the Tables
RMDSYVRSV

SEQ ID NO: 2027 - protein, 9 aa, Artificial Sequence
  Artificially synthesized peptide
  SITE (1)..(9): One or more of the listed amino acids can be phosphorylated as set forth in the Tables
RMFSKELRC

SEQ ID NO: 2028 - protein, 9 aa, Artificial Sequence
  Artificially synthesized peptide
  SITE (1)..(9): One or more of the listed amino acids can be phosphorylated as set forth in the Tables
RLFSKELRV

SEQ ID NO: 2029 - protein, 9 aa, Artificial Sequence
  Artificially synthesized peptide
  SITE (1)..(9): One or more of the listed amino acids can be phosphorylated as set forth in the Tables
RMFSKELRV

SEQ ID NO: 2030 - protein, 9 aa, Artificial Sequence
  Artificially synthesized peptide
  SITE (1)..(9): One or more of the listed amino acids can be phosphorylated as set forth in the Tables
RMLSPLSSA

SEQ ID NO: 2031 - protein, 9 aa, Artificial Sequence
  Artificially synthesized peptide
  SITE (1)..(9): One or more of the listed amino acids can be phosphorylated as set forth in the Tables
RLLSPLSSV

SEQ ID NO: 2032 - protein, 9 aa, Artificial Sequence
  Artificially synthesized peptide
  SITE (1)..(9): One or more of the listed amino acids can be phosphorylated as set forth in the Tables
RMLSPLSSV

SEQ ID NO: 2033 - protein, 9 aa, Artificial Sequence
  Artificially synthesized peptide
  SITE (1)..(9): One or more of the listed amino acids can be phosphorylated as set forth in the Tables
RMQSTSERL

SEQ ID NO: 2034 - protein, 9 aa, Artificial Sequence
  Artificially synthesized peptide
  SITE (1)..(9): One or more of the listed amino acids can be phosphorylated as set forth in the Tables
RLQSTSERV

SEQ ID NO: 2035 - protein, 9 aa, Artificial Sequence
  Artificially synthesized peptide
  SITE (1)..(9): One or more of the listed amino acids can be phosphorylated as set forth in the Tables
RMQSTSERV

SEQ ID NO: 2036 - protein, 9 aa, Artificial Sequence
  Artificially synthesized peptide
  SITE (1)..(9): One or more of the listed amino acids can be phosphorylated as set forth in the Tables
RMSSPLHFV

SEQ ID NO: 2037 - protein, 11 aa, Artificial Sequence
  Artificially synthesized peptide
  SITE (1)..(11): One or more of the listed amino acids can be phosphorylated as set forth in the Tables
RLDSTPGKVFL

SEQ ID NO: 2038 - protein, 11 aa, Artificial Sequence
  Artificially synthesized peptide
  SITE (1)..(11): One or more of the listed amino acids can be phosphorylated as set forth in the Tables
RMDSTPGKVFL

SEQ ID NO: 2039 - protein, 11 aa, Artificial Sequence
  Artificially synthesized peptide
  SITE (1)..(11): One or more of the listed amino acids can be phosphorylated as set forth in the Tables
RQDSTPGKVFV

SEQ ID NO: 2040 - protein, 11 aa, Artificial Sequence
  Artificially synthesized peptide
  SITE (1)..(11): One or more of the listed amino acids can be phosphorylated as set forth in the Tables
RMDSTPGKVFV

SEQ ID NO: 2041 - protein, 11 aa, Artificial Sequence
  Artificially synthesized peptide
  SITE (1)..(11): One or more of the listed amino acids can be phosphorylated as set forth in the Tables
RLDSTPGKVFV

SEQ ID NO: 2042 - protein, 9 aa, Artificial Sequence
  Artificially synthesized peptide
  SITE (1)..(9): One or more of the listed amino acids can be phosphorylated as set forth in the Tables
RLISQDVKL

SEQ ID NO: 2043 - protein, 9 aa, Artificial Sequence
  Artificially synthesized peptide
  SITE (1)..(9): One or more of the listed amino acids can be phosphorylated as set forth in the Tables
RMISQDVKL

SEQ ID NO: 2044 - protein, 9 aa, Artificial Sequence
  Artificially synthesized peptide
  SITE (1)..(9): One or more of the listed amino acids can be phosphorylated as set forth in the Tables
RQISQDVKV

SEQ ID NO: 2045 - protein, 9 aa, Artificial Sequence
  Artificially synthesized peptide
  SITE (1)..(9): One or more of the listed amino acids can be phosphorylated as set forth in the Tables
RLISQDVKV

SEQ ID NO: 2046 - protein, 9 aa, Artificial Sequence
  Artificially synthesized peptide
  SITE (1)..(9): One or more of the listed amino acids can be phosphorylated as set forth in the Tables
RMISQDVKV

SEQ ID NO: 2047 - protein, 10 aa, Artificial Sequence
  Artificially synthesized peptide
  SITE (1)..(10): One or more of the listed amino acids can be phosphorylated as set forth in the Tables
RLLSSGVSEI

SEQ ID NO: 2048 - protein, 10 aa, Artificial Sequence
  Artificially synthesized peptide
  SITE (1)..(10): One or more of the listed amino acids can be phosphorylated as set forth in the Tables
RMLSSGVSEI

SEQ ID NO: 2049 - protein, 10 aa, Artificial Sequence
  Artificially synthesized peptide
  SITE (1)..(10): One or more of the listed amino acids can be phosphorylated as set forth in the Tables
RQLSSGVSEV

SEQ ID NO: 2050 - protein, 10 aa, Artificial Sequence
  Artificially synthesized peptide
  SITE (1)..(10): One or more of the listed amino acids can be phosphorylated as set forth in the Tables
RLLSSGVSEV

SEQ ID NO: 2051 - protein, 10 aa, Artificial Sequence
  Artificially synthesized peptide
  SITE (1)..(10): One or more of the listed amino acids can be phosphorylated as set forth in the Tables
RMLSSGVSEV

SEQ ID NO: 2052 - protein, 9 aa, Artificial Sequence
  Artificially synthesized peptide
  SITE (1)..(9): One or more of the listed amino acids can be phosphorylated as set forth in the Tables
RLFSPTYGL

SEQ ID NO: 2053 - protein, 9 aa, Artificial Sequence
  Artificially synthesized peptide
  SITE (1)..(9): One or more of the listed amino acids can be phosphorylated as set forth in the Tables
RMFSPTYGL

SEQ ID NO: 2054 - protein, 9 aa, Artificial Sequence
  Artificially synthesized peptide
  SITE (1)..(9): One or more of the listed amino acids can be phosphorylated as set forth in the Tables
RTFSPTYGV

SEQ ID NO: 2055 - protein, 9 aa, Artificial Sequence
  Artificially synthesized peptide
  SITE (1)..(9): One or more of the listed amino acids can be phosphorylated as set forth in the Tables
RLFSPTYGV

SEQ ID NO: 2056 - protein, 9 aa, Artificial Sequence
  Artificially synthesized peptide
  SITE (1)..(9): One or more of the listed amino acids can be phosphorylated as set forth in the Tables
RMFSPTYGV

SEQ ID NO: 2057 - protein, 9 aa, Artificial Sequence
  Artificially synthesized peptide
  SITE (1)..(9): One or more of the listed amino acids can be phosphorylated as set forth in the Tables
RLLSHISEA

SEQ ID NO: 2058 - protein, 9 aa, Artificial Sequence
  Artificially synthesized peptide
  SITE (1)..(9): One or more of the listed amino acids can be phosphorylated as set forth in the Tables
RMLSHISEA

SEQ ID NO: 2059 - protein, 9 aa, Artificial Sequence
  Artificially synthesized peptide
  SITE (1)..(9): One or more of the listed amino acids can be phosphorylated as set forth in the Tables
RTLSHISEV

SEQ ID NO: 2060 - protein, 9 aa, Artificial Sequence
  Artificially synthesized peptide
  SITE (1)..(9): One or more of the listed amino acids can be phosphorylated as set forth in the Tables
RLLSHISEV

SEQ ID NO: 2061 - protein, 9 aa, Artificial Sequence
  Artificially synthesized peptide
  SITE (1)..(9): One or more of the listed amino acids can be phosphorylated as set forth in the Tables
RMLSHISEV

SEQ ID NO: 2062 - protein, 9 aa, Artificial Sequence
  Artificially synthesized peptide
  SITE (1)..(9): One or more of the listed amino acids can be phosphorylated as set forth in the Tables
RLASPTSGV

SEQ ID NO: 2063 - protein, 9 aa, Artificial Sequence
  Artificially synthesized peptide
  SITE (1)..(9): One or more of the listed amino acids can be phosphorylated as set forth in the Tables
RMASPTSGV

SEQ ID NO: 2064 - protein, 9 aa, Artificial Sequence
  Artificially synthesized peptide
  SITE (1)..(9): One or more of the listed amino acids can be phosphorylated as set forth in the Tables
SMLTSPPKA

SEQ ID NO: 2065 - protein, 9 aa, Artificial Sequence
  Artificially synthesized peptide
  SITE (1)..(9): One or more of the listed amino acids can be phosphorylated as set forth in the Tables
SLLTSPPKV

SEQ ID NO: 2066 - protein, 9 aa, Artificial Sequence
  Artificially synthesized peptide
  SITE (1)..(9): One or more of the listed amino acids can be phosphorylated as set forth in the Tables
SMLTSPPKV

SEQ ID NO: 2067 - protein, 9 aa, Artificial Sequence
  Artificially synthesized peptide
  SITE (1)..(9): One or more of the listed amino acids can be phosphorylated as set forth in the Tables
SMQPRSHSV

SEQ ID NO: 2068 - protein, 9 aa, Artificial Sequence
  Artificially synthesized peptide
  SITE (1)..(9): One or more of the listed amino acids can be phosphorylated as set forth in the Tables
SLTRSPPRV

SEQ ID NO: 2069 - protein, 11 aa, Artificial Sequence
  Artificially synthesized peptide
  SITE (1)..(11): One or more of the listed amino acids can be phosphorylated as set forth in the Tables
TMASPSVFKST

SEQ ID NO: 2070 - protein, 11 aa, Artificial Sequence
  Artificially synthesized peptide
  SITE (1)..(11): One or more of the listed amino acids can be phosphorylated as set forth in the Tables
TLASPSVFKSV

SEQ ID NO: 2071 - protein, 11 aa, Artificial Sequence
  Artificially synthesized peptide
  SITE (1)..(11): One or more of the listed amino acids can be phosphorylated as set forth in the Tables
TMASPSVFKSV

SEQ ID NO: 2072 - protein, 10 aa, Artificial Sequence
  Artificially synthesized peptide
  SITE (1)..(10): One or more of the listed amino acids can be phosphorylated as set forth in the Tables
VLKGSRSSEV

SEQ ID NO: 2073 - protein, 9 aa, Artificial Sequence
  Artificially synthesized peptide
  SITE (1)..(9): One or more of the listed amino acids can be phosphorylated as set forth in the Tables
VMLSPVPEL

SEQ ID NO: 2074 - protein, 9 aa, Artificial Sequence
  Artificially synthesized peptide
  SITE (1)..(9): One or more of the listed amino acids can be phosphorylated as set forth in the Tables
VLLSPVPEV

SEQ ID NO: 2075 - protein, 9 aa, Artificial Sequence
  Artificially synthesized peptide
  SITE (1)..(9): One or more of the listed amino acids can be phosphorylated as set forth in the Tables
VMLSPVPEV

SEQ ID NO: 2076 - protein, 10 aa, Artificial Sequence
  Artificially synthesized peptide
  SITE (1)..(10): One or more of the listed amino acids can be phosphorylated as set forth in the Tables
VLFRTPLASV

SEQ ID NO: 2077 - protein, 9 aa, Artificial Sequence
  Artificially synthesized peptide
  SITE (1)..(9): One or more of the listed amino acids can be phosphorylated as set forth in the Tables
VLIGSPKKV

SEQ ID NO: 2078 - protein, 10 aa, Artificial Sequence
  Artificially synthesized peptide
  SITE (1)..(10): One or more of the listed amino acids can be phosphorylated as set forth in the Tables
YMDSGIHSGA

SEQ ID NO: 2079 - protein, 10 aa, Artificial Sequence
  Artificially synthesized peptide
  SITE (1)..(10): One or more of the listed amino acids can be phosphorylated as set forth in the Tables
YMDSGIHSGV

SEQ ID NO: 2080 - protein, 10 aa, Artificial Sequence
  Artificially synthesized peptide
  SITE (1)..(10): One or more of the listed amino acids can be phosphorylated as set forth in the Tables
YLDSGIHSGV

SEQ ID NO: 2081 - protein, 10 aa, Artificial Sequence
  Artificially synthesized peptide
  SITE (1)..(10): One or more of the listed amino acids can be phosphorylated as set forth in the Tables
YLDSGIHSGA

SEQ ID NO: 2082 - protein, 10 aa, Artificial Sequence
  Artificially synthesized peptide
  SITE (1)..(10): One or more of the listed amino acids can be phosphorylated as set forth in the Tables
YMDSGIHSGA

SEQ ID NO: 2083 - protein, 10 aa, Artificial Sequence
  Artificially synthesized peptide
  SITE (1)..(10): One or more of the listed amino acids can be phosphorylated as set forth in the Tables
YMDSGIHSGV

SEQ ID NO: 2084 - protein, 10 aa, Artificial Sequence
  Artificially synthesized peptide
  SITE (1)..(10): One or more of the listed amino acids can be phosphorylated as set forth in the Tables
YLDSGIHSGV

SEQ ID NO: 2085 - protein, 11 aa, Artificial Sequence
  Artificially synthesized peptide
  SITE (1)..(11): One or more of the listed amino acids can be phosphorylated as set forth in the Tables
AMDSGASLLHL

SEQ ID NO: 2086 - protein, 11 aa, Artificial Sequence
  Artificially synthesized peptide
  SITE (1)..(11): One or more of the listed amino acids can be phosphorylated as set forth in the Tables
ALDSGASLLHV

SEQ ID NO: 2087 - protein, 11 aa, Artificial Sequence
  Artificially synthesized peptide
  SITE (1)..(11): One or more of the listed amino acids can be phosphorylated as set forth in the Tables
AMDSGASLLHV

SEQ ID NO: 2088 - protein, 11 aa, Artificial Sequence
  Artificially synthesized peptide
  SITE (1)..(11): One or more of the listed amino acids can be phosphorylated as set forth in the Tables
ALGSRESLATV

SEQ ID NO: 2089 - protein, 11 aa, Artificial Sequence
  Artificially synthesized peptide
  SITE (1)..(11): One or more of the listed amino acids can be phosphorylated as set forth in the Tables
AMGSRESLATI

SEQ ID NO: 2090 - protein, 11 aa, Artificial Sequence
  Artificially synthesized peptide
  SITE (1)..(11): One or more of the listed amino acids can be phosphorylated as set forth in the Tables
AMGSRESLATV

SEQ ID NO: 2091 - protein, 13 aa, Artificial Sequence
  Artificially synthesized peptide
  SITE (1)..(13): One or more of the listed amino acids can be phosphorylated as set forth in the Tables
AMLGSKSPDPYRV

SEQ ID NO: 2092 - protein, 13 aa, Artificial Sequence
  Artificially synthesized peptide
  SITE (1)..(13): One or more of the listed amino acids can be phosphorylated as set forth in the Tables
ALLGSKSPDPYRL

SEQ ID NO: 2093 - protein, 13 aa, Artificial Sequence
  Artificially synthesized peptide
  SITE (1)..(13): One or more of the listed amino acids can be phosphorylated as set forth in the Tables
ALLGSKSPDPYRV

SEQ ID NO: 2094 - protein, 9 aa, Artificial Sequence
  Artificially synthesized peptide
  SITE (1)..(9): One or more of the listed amino acids can be phosphorylated as set forth in the Tables
AVIHQSLGV

SEQ ID NO: 2095 - protein, 9 aa, Artificial Sequence
  Artificially synthesized peptide
  SITE (1)..(9): One or more of the listed amino acids can be phosphorylated as set forth in the Tables
ALIHQSLGL

SEQ ID NO: 2096 - protein, 9 aa, Artificial Sequence
  Artificially synthesized peptide
  SITE (1)..(9): One or more of the listed amino acids can be phosphorylated as set forth in the Tables
ALIHQSLGV

SEQ ID NO: 2097 - protein, 8 aa, Artificial Sequence
  Artificially synthesized peptide
  SITE (1)..(8): One or more of the listed amino acids can be phosphorylated as set forth in the Tables
DLSEEKFL

SEQ ID NO: 2098 - protein, 8 aa, Artificial Sequence
  Artificially synthesized peptide
  SITE (1)..(8): One or more of the listed amino acids can be phosphorylated as set forth in the Tables
DSSEEKFV

SEQ ID NO: 2099 - protein, 8 aa, Artificial Sequence
  Artificially synthesized peptide
  SITE (1)..(8): One or more of the listed amino acids can be phosphorylated as set forth in the Tables
DLSEEKFV

SEQ ID NO: 2100 - protein, 12 aa, Artificial Sequence
  Artificially synthesized peptide
  SITE (1)..(12): One or more of the listed amino acids can be phosphorylated as set forth in the Tables
GGSFGGRSSGSV

SEQ ID NO: 2101 - protein, 12 aa, Artificial Sequence
  Artificially synthesized peptide
  SITE (1)..(12): One or more of the listed amino acids can be phosphorylated as set forth in the Tables
GLSFGGRSSGSP

SEQ ID NO: 2102 - protein, 12 aa, Artificial Sequence
  Artificially synthesized peptide
  SITE (1)..(12): One or more of the listed amino acids can be phosphorylated as set forth in the Tables
GLSFGGRSSGSV

SEQ ID NO: 2103 - protein, 11 aa, Artificial Sequence
  Artificially synthesized peptide
  SITE (1)..(11): One or more of the listed amino acids can be phosphorylated as set forth in the Tables
GLLSPARLYAV

SEQ ID NO: 2104 - protein, 11 aa, Artificial Sequence
  Artificially synthesized peptide
  SITE (1)..(11): One or more of the listed amino acids can be phosphorylated as set forth in the Tables
GMLSPARLYAI

SEQ ID NO: 2105 - protein, 11 aa, Artificial Sequence
  Artificially synthesized peptide
  SITE (1)..(11): One or more of the listed amino acids can be phosphorylated as set forth in the Tables
GMLSPARLYAV

SEQ ID NO: 2106 - protein, 9 aa, Artificial Sequence
  Artificially synthesized peptide
  SITE (1)..(9): One or more of the listed amino acids can be phosphorylated as set forth in the Tables
ILDSGIYRV

SEQ ID NO: 2107 - protein, 9 aa, Artificial Sequence
  Artificially synthesized peptide
  SITE (1)..(9): One or more of the listed amino acids can be phosphorylated as set forth in the Tables
IMDSGIYRI

SEQ ID NO: 2108 - protein, 9 aa, Artificial Sequence
  Artificially synthesized peptide
  SITE (1)..(9): One or more of the listed amino acids can be phosphorylated as set forth in the Tables
IMDSGIYRV

SEQ ID NO: 2109 - protein, 9 aa, Artificial Sequence
  Artificially synthesized peptide
  SITE (1)..(9): One or more of the listed amino acids can be phosphorylated as set forth in the Tables
KLKSPAPGL

SEQ ID NO: 2110 - protein, 9 aa, Artificial Sequence
  Artificially synthesized peptide
  SITE (1)..(9): One or more of the listed amino acids can be phosphorylated as set forth in the Tables
KAKSPAPGV

SEQ ID NO: 2111 - protein, 9 aa, Artificial Sequence
  Artificially synthesized peptide
  SITE (1)..(9): One or more of the listed amino acids can be phosphorylated as set forth in the Tables
KLKSPAPGV

SEQ ID NO: 2112 - protein, 10 aa, Artificial Sequence
  Artificially synthesized peptide
  SITE (1)..(10): One or more of the listed amino acids can be phosphorylated as set forth in the Tables
KLFSGVFVKV

SEQ ID NO: 2113 - protein, 10 aa, Artificial Sequence
  Artificially synthesized peptide
  SITE (1)..(10): One or more of the listed amino acids can be phosphorylated as set forth in the Tables
KMFSGVFVKV

SEQ ID NO: 2114 - protein, 9 aa, Artificial Sequence
  Artificially synthesized peptide
  SITE (1)..(9): One or more of the listed amino acids can be phosphorylated as set forth in the Tables
KMDSPRVTV

SEQ ID NO: 2115 - protein, 11 aa, Artificial Sequence
  Artificially synthesized peptide
  SITE (1)..(11): One or more of the listed amino acids can be phosphorylated as set forth in the Tables
KLFSPSKEAEV

SEQ ID NO: 2116 - protein, 11 aa, Artificial Sequence
  Artificially synthesized peptide
  SITE (1)..(11): One or more of the listed amino acids can be phosphorylated as set forth in the Tables
KMFSPSKEAEL

SEQ ID NO: 2117 - protein, 11 aa, Artificial Sequence
  Artificially synthesized peptide
  SITE (1)..(11): One or more of the listed amino acids can be phosphorylated as set forth in the Tables
KMFSPSKEAEV

SEQ ID NO: 2118 - protein, 9 aa, Artificial Sequence
  Artificially synthesized peptide
  SITE (1)..(9): One or more of the listed amino acids can be phosphorylated as set forth in the Tables
KMIDRTESL

SEQ ID NO: 2119 - protein, 10 aa, Artificial Sequence
  Artificially synthesized peptide
  SITE (1)..(10): One or more of the listed amino acids can be phosphorylated as set forth in the Tables
KLMIDRTESV

SEQ ID NO: 2120 - protein, 9 aa, Artificial Sequence
  Artificially synthesized peptide
  SITE (1)..(9): One or more of the listed amino acids can be phosphorylated as set forth in the Tables
KLLQFYPSV

SEQ ID NO: 2121 - protein, 9 aa, Artificial Sequence
  Artificially synthesized peptide
  SITE (1)..(9): One or more of the listed amino acids can be phosphorylated as set forth in the Tables
KMLQFYPSL

SEQ ID NO: 2122 - protein, 9 aa, Artificial Sequence
  Artificially synthesized peptide
  SITE (1)..(9): One or more of the listed amino acids can be phosphorylated as set forth in the Tables
KLMAPDISV

SEQ ID NO: 2123 - protein, 9 aa, Artificial Sequence
  Artificially synthesized peptide
  SITE (1)..(9): One or more of the listed amino acids can be phosphorylated as set forth in the Tables
KMMAPDISV

SEQ ID NO: 2124 - protein, 11 aa, Artificial Sequence
  Artificially synthesized peptide
  SITE (1)..(11): One or more of the listed amino acids can be phosphorylated as set forth in the Tables
KLMSPKADVKV

SEQ ID NO: 2125 - protein, 11 aa, Artificial Sequence
  Artificially synthesized peptide
  SITE (1)..(11): One or more of the listed amino acids can be phosphorylated as set forth in the Tables
KMMSPKADVKV

SEQ ID NO: 2126 - protein, 10 aa, Artificial Sequence
  Artificially synthesized peptide
  SITE (1)..(10): One or more of the listed amino acids can be phosphorylated as set forth in the Tables
KMDSFLDMQV

SEQ ID NO: 2127 - protein, 10 aa, Artificial Sequence
  Artificially synthesized peptide
  SITE (1)..(10): One or more of the listed amino acids can be phosphorylated as set forth in the Tables
KLDSFLDMQV

SEQ ID NO: 2128 - protein, 10 aa, Artificial Sequence
  Artificially synthesized peptide
  SITE (1)..(10): One or more of the listed amino acids can be phosphorylated as set forth in the Tables
KLYSEIDIKV

SEQ ID NO: 2129 - protein, 9 aa, Artificial Sequence
  Artificially synthesized peptide
  SITE (1)..(9): One or more of the listed amino acids can be phosphorylated as set forth in the Tables
KLASLLHQV

SEQ ID NO: 2130 - protein, 9 aa, Artificial Sequence
  Artificially synthesized peptide
  SITE (1)..(9): One or more of the listed amino acids can be phosphorylated as set forth in the Tables
KMASLLHQV

SEQ ID NO: 2131 - protein, 10 aa, Artificial Sequence
  Artificially synthesized peptide
  SITE (1)..(10): One or more of the listed amino acids can be phosphorylated as set forth in the Tables
KLLSTEEMEL

SEQ ID NO: 2132 - protein, 10 aa, Artificial Sequence
  Artificially synthesized peptide
  SITE (1)..(10): One or more of the listed amino acids can be phosphorylated as set forth in the Tables
KLLSTEEMEV

SEQ ID NO: 2133 - protein, 11 aa, Artificial Sequence
  Artificially synthesized peptide
  SITE (1)..(11): One or more of the listed amino acids can be phosphorylated as set forth in the Tables
MLAESPSVPRV

SEQ ID NO: 2134 - protein, 10 aa, Artificial Sequence
  Artificially synthesized peptide
  SITE (1)..(10): One or more of the listed amino acids can be phosphorylated as set forth in the Tables
RLASLNAEAV

SEQ ID NO: 2135 - protein, 12 aa, Artificial Sequence
  Artificially synthesized peptide
  SITE (4)..(7): One or more of the listed serines can be phosphorylated
RLRSLSSPTVTL

SEQ ID NO: 2136 - protein, 12 aa, Artificial Sequence
  Artificially synthesized peptide
  SITE (4)..(7): One or more of the listed serines can be phosphorylated
RLRSLSSPTVTV

SEQ ID NO: 2137 - protein, 12 aa, Artificial Sequence
  Artificially synthesized peptide
  SITE (4)..(7): One or more of the listed serines can be phosphorylated
RPRSLSSPTVTV

SEQ ID NO: 2138 - protein, 10 aa, Artificial Sequence
  Artificially synthesized peptide
  SITE (1)..(10): One or more of the listed amino acids can be phosphorylated as set forth in the Tables
RQASIELPSV

SEQ ID NO: 2139 - protein, 10 aa, Artificial Sequence
  Artificially synthesized peptide
  SITE (1)..(10): One or more of the listed amino acids can be phosphorylated as set forth in the Tables
RLASIELPSV

SEQ ID NO: 2140 - protein, 10 aa, Artificial Sequence
  Artificially synthesized peptide
  SITE (1)..(10): One or more of the listed amino acids can be phosphorylated as set forth in the Tables
RLASIELPSM

SEQ ID NO: 2141 - protein, 12 aa, Artificial Sequence
  Artificially synthesized peptide
  SITE (1)..(12): One or more of the listed amino acids can be phosphorylated as set forth in the Tables
RLASIELPSMAV

SEQ ID NO: 2142 - protein, 9 aa, Artificial Sequence
  Artificially synthesized peptide
  SITE (1)..(9): One or more of the listed amino acids can be phosphorylated as set forth in the Tables
RLASLSISV

SEQ ID NO: 2143 - protein, 9 aa, Artificial Sequence
  Artificially synthesized peptide
  SITE (1)..(9): One or more of the listed amino acids can be phosphorylated as set forth in the Tables
RLISFKAEV

SEQ ID NO: 2144 - protein, 9 aa, Artificial Sequence
  Artificially synthesized peptide
  SITE (1)..(9): One or more of the listed amino acids can be phosphorylated as set forth in the Tables
RLISQDVKL

SEQ ID NO: 2145 - protein, 9 aa, Artificial Sequence
  Artificially synthesized peptide
  SITE (1)..(9): One or more of the listed amino acids can be phosphorylated as set forth in the Tables
RQISQDVKV

SEQ ID NO: 2146 - protein, 9 aa, Artificial Sequence
  Artificially synthesized peptide
  SITE (1)..(9): One or more of the listed amino acids can be phosphorylated as set forth in the Tables
RLISQDVKV

SEQ ID NO: 2147 - protein, 10 aa, Artificial Sequence
  Artificially synthesized peptide
  SITE (1)..(10): One or more of the listed amino acids can be phosphorylated as set forth in the Tables
RLLSSGVSEI

SEQ ID NO: 2148 - protein, 10 aa, Artificial Sequence
  Artificially synthesized peptide
  SITE (1)..(10): One or more of the listed amino acids can be phosphorylated as set forth in the Tables
RQLSSGVSEV

SEQ ID NO: 2149 - protein, 10 aa, Artificial Sequence
  Artificially synthesized peptide
  SITE (1)..(10): One or more of the listed amino acids can be phosphorylated as set forth in the Tables
RLLSSGVSEV

SEQ ID NO: 2150 - protein, 9 aa, Artificial Sequence
  Artificially synthesized peptide
  SITE (1)..(9): One or more of the listed amino acids can be phosphorylated as set forth in the Tables
RLFSPTYGL

SEQ ID NO: 2151 - protein, 9 aa, Artificial Sequence
  Artificially synthesized peptide
  SITE (1)..(9): One or more of the listed amino acids can be phosphorylated as set forth in the Tables
RTFSPTYGV

SEQ ID NO: 2152 - protein, 10 aa, Artificial Sequence
  Artificially synthesized peptide
  SITE (1)..(10): One or more of the listed amino acids can be phosphorylated as set forth in the Tables
RLTFSPTYGV

SEQ ID NO: 2153 - protein, 10 aa, Artificial Sequence
  Artificially synthesized peptide
  SITE (1)..(10): One or more of the listed amino acids can be phosphorylated as set forth in the Tables
RLYSGPMNKV

SEQ ID NO: 2154 - protein, 9 aa, Artificial Sequence
  Artificially synthesized peptide
  SITE (1)..(9): One or more of the listed amino acids can be phosphorylated as set forth in the Tables
RLASPTSGV

SEQ ID NO: 2155 - protein, 9 aa, Artificial Sequence
  Artificially synthesized peptide
  SITE (1)..(9): One or more of the listed amino acids can be phosphorylated as set forth in the Tables
RMASPTSGV

SEQ ID NO: 2156 - protein, 9 aa, Artificial Sequence
  Artificially synthesized peptide
  SITE (1)..(9): One or more of the listed amino acids can be phosphorylated as set forth in the Tables
SLTRSPPRV

SEQ ID NO: 2157 - protein, 9 aa, Artificial Sequence
  Artificially synthesized peptide
  SITE (1)..(9): One or more of the listed amino acids can be phosphorylated as set forth in the Tables
SLTRSPPRV

SEQ ID NO: 2158 - protein, 9 aa, Artificial Sequence
  Artificially synthesized peptide
  SITE (1)..(9): One or more of the listed amino acids can be phosphorylated as set forth in the Tables
VLLSPVPEV

SEQ ID NO: 2159 - protein, 10 aa, Artificial Sequence
  Artificially synthesized peptide
  SITE (5)..(7): One or more of the listed serines can be phosphorylated
VLMKSPSPAV

SEQ ID NO: 2160 - protein, 9 aa, Artificial Sequence
  Artificially synthesized peptide
  SITE (1)..(9): One or more of the listed amino acids can be phosphorylated as set forth in the Tables
VLIGSPKKV

SEQ ID NO: 2161 - protein, 11 aa, Artificial Sequence
  Artificially synthesized peptide
  SITE (1)..(11): One or more of the listed amino acids can be phosphorylated as set forth in the Tables
YLLSPTKLPSI

SEQ ID NO: 2162 - protein, 11 aa, Artificial Sequence
  Artificially synthesized peptide
  SITE (1)..(11): One or more of the listed amino acids can be phosphorylated as set forth in the Tables
YQLSPTKLPSV

SEQ ID NO: 2163 - protein, 11 aa, Artificial Sequence
  Artificially synthesized peptide
  SITE (1)..(11): The peptide is optionally O-GlcNAcylated
YLLSPTKLPSV

SEQ ID NO: 2164 - protein, 9 aa, Homo sapiens
  SITE (1)..(9): The peptide is optionally O-GlcNAcylated
IPVSSHNSL

SEQ ID NO: 2165 - protein, 9 aa, Homo sapiens
  SITE (1)..(9): The peptide is optionally O-GlcNAcylated
RPPITQSSL

SEQ ID NO: 2166 - protein, 9 aa, Homo sapiens
  SITE (1)..(9): The peptide is optionally singly methylated
RPPITQSSL

SEQ ID NO: 2167 - protein, 9 aa, Homo sapiens
  SITE (1)..(9): The peptide is optionally doubly methylated
RPPITQSSL

SEQ ID NO: 2168 - protein, 9 aa, Homo sapiens
  SITE (1)..(9): One or more of the listed amino acids can be phosphorylated as set forth in the Tables
YLEPGPVTA

SEQ ID NO: 2169 - protein, 10 aa, Homo sapiens
  SITE (1)..(10): One or more of the listed amino acids can be phosphorylated as set forth in the Tables
DYMDGTMSQV

SEQ ID NO: 2170 - protein, 9 aa, Homo sapiens
  SITE (1)..(9): One or more of the listed amino acids can be phosphorylated as set forth in the Tables
ALLAVGATK

SEQ ID NO: 2171 - protein, 9 aa, Homo sapiens
  SITE (1)..(9): One or more of the listed amino acids can be phosphorylated as set forth in the Tables
KCDICTDEY

SEQ ID NO: 2172 - protein, 9 aa, Homo sapiens
  SITE (1)..(9): One or more of the listed amino acids can be phosphorylated as set forth in the Tables
RLSNRLLLR

SEQ ID NO: 2173 - protein, 9 aa, Homo sapiens
  SITE (1)..(9): One or more of the listed amino acids can be phosphorylated as set forth in the Tables
SQNFPGSQK

SEQ ID NO: 2174 - protein, 9 aa, Homo sapiens
  SITE (1)..(9): One or more of the listed amino acids can be phosphorylated as set forth in the Tables
KTWGQYWQV

SEQ ID NO: 2175 - protein, 9 aa, Homo sapiens
  SITE (1)..(9): One or more of the listed amino acids can be phosphorylated as set forth in the Tables
  SITE (2)..(2): the Xaa at position 2 can be Thr or Met
IXDQVPFSV

SEQ ID NO: 2176 - protein, 10 aa, Homo sapiens
  SITE (1)..(10): One or more of the listed amino acids can be phosphorylated as set forth in the Tables
VLYRYGSFSV

SEQ ID NO: 2177 - protein, 9 aa, Homo sapiens
  SITE (1)..(9): One or more of the listed amino acids can be phosphorylated as set forth in the Tables
AAGIGILTV

SEQ ID NO: 2178 - protein, 9 aa, Homo sapiens
  SITE (1)..(9): One or more of the listed amino acids can be phosphorylated as set forth in the Tables
ALNFPGSQK

SEQ ID NO: 2179 - protein, 9 aa, Homo sapiens
  SITE (1)..(9): One or more of the listed amino acids can be phosphorylated as set forth in the Tables
LIYRRRLMK

SEQ ID NO: 2180 - protein, 9 aa, Homo sapiens
  SITE (1)..(9): One or more of the listed amino acids can be phosphorylated as set forth in the Tables
AAQERRVPR

SEQ ID NO: 2181 - protein, 10 aa, Homo sapiens
  SITE (1)..(10): One or more of the listed amino acids can be phosphorylated as set forth in the Tables
ASGPGGGAPR

SEQ ID NO: 2182 - protein, 9 aa, Homo sapiens
  SITE (1)..(9): One or more of the listed amino acids can be phosphorylated as set forth in the Tables
LLGPGRPYR

SEQ ID NO: 2183 - protein, 13 aa, Homo sapiens
  SITE (1)..(13): One or more of the listed amino acids can be phosphorylated as set forth in the Tables
SDAEKSDICTDEY

SEQ ID NO: 2184 - protein, 11 aa, Homo sapiens
  SITE (1)..(11): One or more of the listed amino acids can be phosphorylated as set forth in the Tables
SSDYVIPIGTY

SEQ ID NO: 2185 - protein, 9 aa, Homo sapiens
  SITE (1)..(9): One or more of the listed amino acids can be phosphorylated as set forth in the Tables
EADPTGHSY

SEQ ID NO: 2186 - protein, 9 aa, Homo sapiens
  SITE (1)..(9): One or more of the listed amino acids can be phosphorylated as set forth in the Tables
EVDPIGHLY

SEQ ID NO: 2187 - protein, 10 aa, Homo sapiens
  SITE (1)..(10): One or more of the listed amino acids can be phosphorylated as set forth in the Tables
DYMDGTMSQV

SEQ ID NO: 2188 - protein, 9 aa, Homo sapiens
  SITE (1)..(9): One or more of the listed amino acids can be phosphorylated as set forth in the Tables
IMDQVPFSV

SEQ ID NO: 2189 - protein, 9 aa, Homo sapiens
  SITE (1)..(9): One or more of the listed amino acids can be phosphorylated as set forth in the Tables
YLEPGPVTA

SEQ ID NO: 2190 - protein, 9 aa, Homo sapiens
  SITE (1)..(9): One or more of the listed amino acids can be phosphorylated as set forth in the Tables
GLYDGMEHL

SEQ ID NO: 2191 - protein, 9 aa, Homo sapiens
  SITE (1)..(9): One or more of the listed amino acids can be phosphorylated as set forth in the Tables
LIYRRRLMK

SEQ ID NO: 2192 - protein, 10 aa, Homo sapiens
  SITE (1)..(10): One or more of the listed amino acids can be phosphorylated as set forth in the Tables
ASGPGGGAPR

SEQ ID NO: 2193 - protein, 16 aa, Homo sapiens
  SITE (1)..(16): One or more of the listed amino acids can be phosphorylated as set forth in the Tables
AQNILLSNAPLGPQFP

SEQ ID NO: 2194 - protein, 21 aa, Homo sapiens [sequence omitted]

SEQ ID NO: 2195 - protein, 23 aa, Homo sapiens
  SITE (1)..(23): One or more of the listed amino acids can be phosphorylated as set forth in the Tables
RNGYRALMDKSLHVGTQCALTRR

SEQ ID NO: 2196 - protein, 15 aa, Homo sapiens
  SITE (1)..(15): One or more of the listed amino acids can be phosphorylated as set forth in the Tables
TSYVKVLHHMVKISG

SEQ ID NO: 2197 - protein, 14 aa, Homo sapiens
  SITE (1)..(14): One or more of the listed amino acids can be phosphorylated as set forth in the Tables
LLKYRAREPVTKAE

SEQ ID NO: 2198 - protein, 16 aa, Homo sapiens
  SITE (1)..(16): One or more of the listed amino acids can be phosphorylated as set forth in the Tables
WNRQLYPEWTEAQRLD

SEQ ID NO: 2199 - protein, 16 aa, Homo sapiens
  SITE (1)..(16): One or more of the listed amino acids can be phosphorylated as set forth in the Tables
AQYIKANSKFIGITEL

SEQ ID NO: 2200 - protein, 9 aa, Homo sapiens
  SITE (1)..(9): One or more of the listed amino acids can be phosphorylated as set forth in the Tables
KIFGSLAFL

SEQ ID NO: 2201 - protein, 9 aa, Homo sapiens
  SITE (1)..(9): One or more of the listed amino acids can be phosphorylated as set forth in the Tables
YLSGADLNL

SEQ ID NO: 2202 - protein, 9 aa, Homo sapiens
  SITE (1)..(9): One or more of the listed amino acids can be phosphorylated as set forth in the Tables
VLRENTSPK

SEQ ID NO: 2203 - protein, 9 aa, Homo sapiens
  SITE (1)..(9): One or more of the listed amino acids can be phosphorylated as set forth in the Tables
EADPTGHSY

SEQ ID NO: 2204 - protein, 9 aa, Homo sapiens
  SITE (1)..(9): One or more of the listed amino acids can be phosphorylated as set forth in the Tables
EIWTHSYKV

SEQ ID NO: 2205 - protein, 9 aa, Homo sapiens
  SITE (1)..(9): One or more of the listed amino acids can be phosphorylated as set forth in the Tables
SLFRAVITK

SEQ ID NO: 2206 - protein, 9 aa, Homo sapiens
  SITE (1)..(9): One or more of the listed amino acids can be phosphorylated as set forth in the Tables
EVDPIGHLY

SEQ ID NO: 2207 - protein, 9 aa, Homo sapiens
  SITE (1)..(9): One or more of the listed amino acids can be phosphorylated as set forth in the Tables
GLYDGMEHL

SEQ ID NO: 2208 - protein, 9 aa, Homo sapiens
  SITE (1)..(9): One or more of the listed amino acids can be phosphorylated as set forth in the Tables
HLFGYSWYK

SEQ ID NO: 2209 - protein, 10 aa, Homo sapiens
  SITE (1)..(10): One or more of the listed amino acids can be phosphorylated as set forth in the Tables
ASGPGGGAPR

SEQ ID NO: 2210 - protein, 9 aa, Homo sapiens
  SITE (1)..(9): One or more of the listed amino acids can be phosphorylated as set forth in the Tables
APPAYEKLS

SEQ ID NO: 2211 - protein, 9 aa, Homo sapiens
  SITE (1)..(9): One or more of the listed amino acids can be phosphorylated as set forth in the Tables
PPAYEKLSA

SEQ ID NO: 2212 - protein, 9 aa, Homo sapiens
  SITE (1)..(9): One or more of the listed amino acids can be phosphorylated as set forth in the Tables
PAYEKLSAE

SEQ ID NO: 2213 - protein, 20 aa, Homo sapiens
  SITE (1)..(12): One or more of the listed amino acids can be phosphorylated as set forth in the Tables
VPNAPPAYEKLSAEQSPPPY

SEQ ID NO: 2214 - protein, 12 aa, Homo sapiens
  SITE (1)..(12): One or more of the listed amino acids can be phosphorylated as set forth in the Tables
PNAPPAYEKLSA

SEQ ID NO: 2215 - protein, 12 aa, Homo sapiens
  SITE (1)..(12): One or more of the listed amino acids can be phosphorylated as set forth in the Tables
NAPPAYEKLSAE

SEQ ID NO: 2216 - protein, 12 aa, Homo sapiens
  SITE (1)..(12): One or more of the listed amino acids can be phosphorylated as set forth in the Tables
APPAYEKLSAEQ

SEQ ID NO: 2217 - protein, 15 aa, Homo sapiens
  SITE (1)..(15): One or more of the listed amino acids can be phosphorylated as set forth in the Tables
APPAYEKLSAEQSPP

SEQ ID NO: 2218 - protein, 16 aa, Homo sapiens
  SITE (1)..(16): One or more of the listed amino acids can be phosphorylated as set forth in the Tables
APPAYEKLSAEQSPPP

SEQ ID NO: 2219 - protein, 16 aa, Homo sapiens
  SITE (1)..(16): One or more of the listed amino acids can be phosphorylated as set forth in the Tables
APPAYEKLSAEQSPPP

SEQ ID NO: 2220 - protein, 12 aa, Homo sapiens
  SITE (1)..(12): One or more of the listed amino acids can be phosphorylated as set forth in the Tables
PPAYEKLSAEQS

SEQ ID NO: 2221 - protein, 12 aa, Homo sapiens
  SITE (1)..(12): One or more of the listed amino acids can be phosphorylated as set forth in the Tables
PAYEKLSAEQSP

SEQ ID NO: 2222 - protein, 12 aa, Homo sapiens
  SITE (1)..(12): One or more of the listed amino acids can be phosphorylated as set forth in the Tables
AYEKLSAEQSPP

SEQ ID NO: 2223 - protein, 12 aa, Homo sapiens
  SITE (1)..(12): One or more of the listed amino acids can be phosphorylated as set forth in the Tables
YEKLSAEQSPPP

SEQ ID NO: 2224 - protein, 12 aa, Homo sapiens
  SITE (1)..(12): One or more of the listed amino acids can be phosphorylated as set forth in the Tables
APPAYEKLSAEQ

SEQ ID NO: 2225 - protein, 15 aa, Homo sapiens
  SITE (1)..(15): One or more of the listed amino acids can be phosphorylated as set forth in the Tables
APPAYEKLSAEQSPP

SEQ ID NO: 2226 - protein, 16 aa, Homo sapiens
  SITE (1)..(16): One or more of the listed amino acids can be phosphorylated as set forth in the Tables
APPAYEKLSAEQSPPP

SEQ ID NO: 2227 - protein, 12 aa, Homo sapiens
  SITE (1)..(12): One or more of the listed amino acids can be phosphorylated as set forth in the Tables
APPAYEKLSAEQ

SEQ ID NO: 2228 - protein, 15 aa, Homo sapiens
  SITE (1)..(15): One or more of the listed amino acids can be phosphorylated as set forth in the Tables
APPAYEKLSAEQSPP

SEQ ID NO: 2229 - protein, 16 aa, Homo sapiens
  SITE (1)..(16): One or more of the listed amino acids can be phosphorylated as set forth in the Tables
APPAYEKLSAEQSPPP

SEQ ID NO: 2230 - protein, 17 aa, Homo sapiens
  SITE (1)..(17): One or more of the listed amino acids can be phosphorylated as set forth in the Tables
APPAYEKLSAEQSPPPY

SEQ ID NO: 2231 - protein, 12 aa, Homo sapiens
  SITE (1)..(12): One or more of the listed amino acids can be phosphorylated as set forth in the Tables
VSKVMIGSPKKV

SEQ ID NO: 2232 - protein, 9 aa, Homo sapiens
  SITE (1)..(9): One or more of the listed amino acids can be phosphorylated as set forth in the Tables
VMIGSPKKV

SEQ ID NO: 2233 - protein, 10 aa, Homo sapiens
  SITE (1)..(10): One or more of the listed amino acids can be phosphorylated as set forth in the Tables
KYSPGKLRGN

SEQ ID NO: 2234 - protein, 22 aa, Homo sapiens
  SITE (1)..(22): One or more of the listed amino acids can be phosphorylated as set forth in the Tables
SKEDKNGHDGDTHQEDDGEKSD

SEQ ID NO: 2235 - protein, 28 aa, Homo sapiens
  SITE (1)..(28): One or more of the listed amino acids can be phosphorylated as set forth in the Tables
GSALGGGGAGLSGRASGGAQSPLRYLHV

SEQ ID NO: 2236 - protein, 25 aa, Homo sapiens
  SITE (1)..(25): One or more of the listed amino acids can be phosphorylated as set forth in the Tables
LGGGGAGLSGRASGGAQSPLRYLHV

SEQ ID NO: 2237 - protein, 14 aa, Homo sapiens
  SITE (1)..(14): One or more of the listed amino acids can be phosphorylated as set forth in the Tables
SGGAQSPLRYLHVL

SEQ ID NO: 2238 - protein, 19 aa, Homo sapiens
  SITE (1)..(19): One or more of the listed amino acids can be phosphorylated as set forth in the Tables
EEGSPTMVEKGLEPGVFTL

SEQ ID NO: 2239 - protein, 18 aa, Homo sapiens
  SITE (1)..(18): One or more of the listed amino acids can be phosphorylated as set forth in the Tables
EGSPTMVEKGLEPGVFTL

SEQ ID NO: 2240 - protein, 17 aa, Homo sapiens
  SITE (1)..(17): One or more of the listed amino acids can be phosphorylated as set forth in the Tables
GSPTMVEKGLEPGVFTL

SEQ ID NO: 2241 - protein, 24 aa, Homo sapiens
  SITE (1)..(24): One or more of the listed amino acids can be phosphorylated as set forth in the Tables
EEMPENALPSDEDDKDPNDPYRAL

SEQ ID NO: 2242 - protein, 14 aa, Homo sapiens
  SITE (1)..(14): One or more of the listed amino acids can be phosphorylated as set forth in the Tables
QAASNFKSPVKTIR

SEQ ID NO: 2243 - protein, 13 aa, Homo sapiens
  SITE (1)..(13): One or more of the listed amino acids can be phosphorylated as set forth in the Tables
AASNFKSPVKTIR

SEQ ID NO: 2244 - protein, 11 aa, Homo sapiens
  SITE (1)..(11): One or more of the listed amino acids can be phosphorylated as set forth in the Tables
SNFKSPVKTIR

SEQ ID NO: 2245 - protein, 10 aa, Homo sapiens
  SITE (1)..(10): One or more of the listed amino acids can be phosphorylated as set forth in the Tables
NFKSPVKTIR

SEQ ID NO: 2246 - protein, 9 aa, Homo sapiens
  SITE (1)..(9): One or more of the listed amino acids can be phosphorylated as set forth in the Tables
FKSPVKTIR

SEQ ID NO: 2247 - protein, 17 aa, Homo sapiens
  SITE (1)..(17): One or more of the listed amino acids can be phosphorylated as set forth in the Tables
YYTAGSSSPTHAKSAHV

SEQ ID NO: 2248 - protein, 12 aa, Homo sapiens
  SITE (1)..(12): One or more of the listed amino acids can be phosphorylated as set forth in the Tables
SSSPTHAKSAHV

SEQ ID NO: 2249 - protein, 17 aa, Homo sapiens
  SITE (1)..(17): One or more of the listed amino acids can be phosphorylated as set forth in the Tables
VRQSVTSFPDADAFHHQ

SEQ ID NO: 2250 - protein, 12 aa, Homo sapiens
  SITE (1)..(12): One or more of the listed amino acids can be phosphorylated as set forth in the Tables
FKMPQEKSPGYS

SEQ ID NO: 2251 - protein, 11 aa, Homo sapiens
  SITE (1)..(11): One or more of the listed amino acids can be phosphorylated as set forth in the Tables
RVASPTSGVKR

SEQ ID NO: 2252 - protein, 28 aa, Homo sapiens
  SITE (1)..(28): One or more of the listed amino acids can be phosphorylated as set forth in the Tables
QVAMPVKKSPRRSSSDEQGLSYSSLKNV

SEQ ID NO: 2253 - protein, 27 aa, Homo sapiens
  SITE (1)..(27): One or more of the listed amino acids can be phosphorylated as set forth in the Tables
VAMPVKKSPRRSSSDEQGLSYSSLKNV

SEQ ID NO: 2254 - protein, 17 aa, Homo sapiens
  SITE (1)..(17): One or more of the listed amino acids can be phosphorylated as set forth in the Tables
SSNGKMASRRSEEKEAG

SEQ ID NO: 2255 - protein, 19 aa, Homo sapiens
  SITE (1)..(19): One or more of the listed amino acids can be phosphorylated as set forth in the Tables
SSNGKMASRRSEEKEAGEI

SEQ ID NO: 2256 - protein, 24 aa, Homo sapiens
  SITE (1)..(24): One or more of the listed amino acids can be phosphorylated as set forth in the Tables
KEGEEPTVYSDEEEPKDESARKND

SEQ ID NO: 2257 - protein, 23 aa, Homo sapiens
  SITE (1)..(23): One or more of the listed amino acids can be phosphorylated as set forth in the Tables
EGEEPTVYSDEEEPKDESARKND

SEQ ID NO: 2258 - protein, 27 aa, Homo sapiens
  SITE (1)..(27): One or more of the listed amino acids can be phosphorylated as set forth in the Tables
ASKMTQPQSKSAFPLSRKNKGSGSLDG

SEQ ID NO: 2259 - protein, 25 aa, Homo sapiens
  SITE (1)..(25): One or more of the listed amino acids can be phosphorylated as set forth in the Tables
APPPLVPAPRPSSPPRGPGPARADR

SEQ ID NO: 2260 - protein, 22 aa, Homo sapiens
SAARESHPHGVKRSASPDDDLG

SEQ ID NO: 2261 - protein, 22 aa, Homo sapiens
  SITE (1)..(1): The serine at this position is acylated at the N-terminus
SAARESHPHGVKRSASPDDDLG

SEQ ID NO: 2262 - protein, 13 aa, Homo sapiens
  SITE (1)..(13): One or more of the listed amino acids can be phosphorylated as set forth in the Tables
ASKASPTLDFTER

SEQ ID NO: 2263 - protein, 16 aa, Homo sapiens
  SITE (1)..(16): One or more of the listed amino acids can be phosphorylated as set forth in the Tables
GERSPLLSQETAGQKP

SEQ ID NO: 2264 - protein, 17 aa, Homo sapiens
  SITE (1)..(17): One or more of the listed amino acids can be phosphorylated as set forth in the Tables
GERSPLLSQETAGQKPL

SEQ ID NO: 2265 - protein, 15 aa, Homo sapiens
  SITE (1)..(15): One or more of the listed amino acids can be phosphorylated as set forth in the Tables
ERSPLLSQETAGQKP

SEQ ID NO: 2266 - protein, 16 aa, Homo sapiens
  SITE (1)..(16): One or more of the listed amino acids can be phosphorylated as set forth in the Tables
ERSPLLSQETAGQKPL

SEQ ID NO: 2267 - protein, 15 aa, Homo sapiens
  SITE (1)..(15): One or more of the listed amino acids can be phosphorylated as set forth in the Tables
TIGEKKEPSDKSVDS

SEQ ID NO: 2268 - protein, 18 aa, Homo sapiens
  SITE (1)..(18): One or more of the listed amino acids can be phosphorylated as set forth in the Tables
SGPKPLFRRMSSLVGPTQ

SEQ ID NO: 2269 - protein, 11 aa, Homo sapiens
  SITE (1)..(11): One or more of the listed amino acids can be phosphorylated as set forth in the Tables
GPKPLFRRMSS

SEQ ID NO: 2270 - protein, 12 aa, Homo sapiens
  SITE (1)..(12): One or more of the listed amino acids can be phosphorylated as set forth in the Tables
GPKPLFRRMSSL

SEQ ID NO: 2271 - protein, 13 aa, Homo sapiens
  SITE (1)..(13): One or more of the listed amino acids can be phosphorylated as set forth in the Tables
GPKPLFRRMSSLV

SEQ ID NO: 2272 - protein, 14 aa, Homo sapiens
  SITE (1)..(14): One or more of the listed amino acids can be phosphorylated as set forth in the Tables
GPKPLFRRMSSLVG

SEQ ID NO: 2273 - protein, 15 aa, Homo sapiens
  SITE (1)..(15): One or more of the listed amino acids can be phosphorylated as set forth in the Tables
GPKPLFRRMSSLVGP

SEQ ID NO: 2274 - protein, 16 aa, Homo sapiens
  SITE (1)..(16): One or more of the listed amino acids can be phosphorylated as set forth in the Tables
GPKPLFRRMSSLVGPT

SEQ ID NO: 2275 - protein, 17 aa, Homo sapiens
  SITE (1)..(17): One or more of the listed amino acids can be phosphorylated as set forth in the Tables
GPKPLFRRMSSLVGPTQ

SEQ ID NO: 2276 - protein, 18 aa, Homo sapiens
  SITE (1)..(18): One or more of the listed amino acids can be phosphorylated as set forth in the Tables
GPKPLFRRMSSLVGPTQS

SEQ ID NO: 2277 - protein, 16 aa, Homo sapiens
  SITE (1)..(16): One or more of the listed amino acids can be phosphorylated as set forth in the Tables
ASPTIEAQGTSPAHDN

SEQ ID NO: 2278 - protein, 17 aa, Homo sapiens
  SITE (1)..(17): One or more of the listed amino acids can be phosphorylated as set forth in the Tables
ASPTIEAQGTSPAHDNI

SEQ ID NO: 2279 - protein, 18 aa, Homo sapiens
  SITE (1)..(18): One or more of the listed amino acids can be phosphorylated as set forth in the Tables
ASPTIEAQGTSPAHDNIA

SEQ ID NO: 2280 - protein, 16 aa, Homo sapiens
  SITE (1)..(16): One or more of the listed amino acids can be phosphorylated as set forth in the Tables
SSSWRILGSKQSEHRP

SEQ ID NO: 2281 - protein, 19 aa, Homo sapiens
  SITE (1)..(19): One or more of the listed amino acids can be phosphorylated as set forth in the Tables
SPPFPVPVYTRQAPKQVIK

SEQ ID NO: 2282 - protein, 18 aa, Homo sapiens
  SITE (1)..(18): One or more of the listed amino acids can be phosphorylated as set forth in the Tables
DPTRRFFKVTPPPGSGPQ

SEQ ID NO: 2283 - protein, 18 aa, Homo sapiens
  SITE (1)..(18): One or more of the listed amino acids can be phosphorylated as set forth in the Tables
RSPEDEYELLMPHRISSH

SEQ ID NO: 2284 - protein, 17 aa, Homo sapiens
  SITE (1)..(17): One or more of the listed amino acids can be phosphorylated as set forth in the Tables
SPEDEYELLMPHRISSH

SEQ ID NO: 2285 - protein, 17 aa, Homo sapiens
  SITE (1)..(17): One or more of the listed amino acids can be phosphorylated as set forth in the Tables
SPEDEYELLMPHRISSH

SEQ ID NO: 2286 - protein, 12 aa, Homo sapiens
  SITE (1)..(12): One or more of the listed amino acids can be phosphorylated as set forth in the Tables
ELLMPHRISSHF

SEQ ID NO: 2287 - protein, 13 aa, Homo sapiens
  SITE (1)..(13): One or more of the listed amino acids can be phosphorylated as set forth in the Tables
ELLMPHRISSHFL

SEQ ID NO: 2288 - protein, 19 aa, Homo sapiens
  SITE (1)..(19): One or more of the listed amino acids can be phosphorylated as set forth in the Tables
TPDPSKFFSQLSSEHGGDV

SEQ ID NO: 2289 - protein, 20 aa, Homo sapiens
  SITE (1)..(20): One or more of the listed amino acids can be phosphorylated as set forth in the Tables
TPDPSKFFSQLSSEHGGDVQ

SEQ ID NO: 2290 - protein, 12 aa, Homo sapiens
  SITE (1)..(12): One or more of the listed amino acids can be phosphorylated as set forth in the Tables
SDFHAERAAREK

SEQ ID NO: 2291 - protein, 18 aa, Homo sapiens
  SITE (1)..(18): One or more of the listed amino acids can be phosphorylated as set forth in the Tables
SPERPFLAILGGAKVADK

SEQ ID NO: 2292 - protein, 20 aa, Homo sapiens
  SITE (1)..(20): One or more of the listed amino acids can be phosphorylated as set forth in the Tables
SPERPFLAILGGAKVADKIQ

SEQ ID NO: 2293 - protein, 18 aa, Homo sapiens
  SITE (1)..(18): One or more of the listed amino acids can be phosphorylated as set forth in the Tables
TKDKYMASRGQKAKSMEG

SEQ ID NO: 2294 - protein, 13 aa, Homo sapiens
  SITE (1)..(13): One or more of the listed amino acids can be phosphorylated as set forth in the Tables
VPHHGFEDWSQIR

SEQ ID NO: 2295 - protein, 16 aa, Homo sapiens
  SITE (1)..(16): One or more of the listed amino acids can be phosphorylated as set forth in the Tables
KIEKIYIMKADTVIVG

SEQ ID NO: 2296 - protein, 15 aa, Homo sapiens
  SITE (1)..(15): One or more of the listed amino acids can be phosphorylated as set forth in the Tables
IEKIYIMKADTVIVG

SEQ ID NO: 2297 - protein, 10 aa, Homo sapiens
  SITE (1)..(10): One or more of the listed amino acids can be phosphorylated as set forth in the Tables
EESSDDGKKY

SEQ ID NO: 2298 - protein, 8 aa, Homo sapiens
  SITE (1)..(8): One or more of the listed amino acids can be phosphorylated as set forth in the Tables
KNRSWKYN

SEQ ID NO: 2299 - protein, 9 aa, Homo sapiens
  SITE (1)..(9): One or more of the listed amino acids can be phosphorylated as set forth in the Tables
KNRSWKYNQ

SEQ ID NO: 2300 - protein, 14 aa, Homo sapiens
  SITE (1)..(14): One or more of the listed amino acids can be phosphorylated as set forth in the Tables
KNRSWKYNQSISLR

SEQ ID NO: 2301 - protein, 16 aa, Homo sapiens
  SITE (1)..(16): One or more of the listed amino acids can be phosphorylated as set forth in the Tables
KNRSWKYNQSISLRRP

SEQ ID NO: 2302 - protein, 13 aa, Homo sapiens
  SITE (1)..(13): One or more of the listed amino acids can be phosphorylated as set forth in the Tables
NRSWKYNQSISLR

SEQ ID NO: 2303 - protein, 15 aa, Homo sapiens
  SITE (1)..(15): One or more of the listed amino acids can be phosphorylated as set forth in the Tables
NRSWKYNQSISLRRP

SEQ ID NO: 2304 - protein, 14 aa, Homo sapiens
  SITE (1)..(14): One or more of the listed amino acids can be phosphorylated as set forth in the Tables
RSWKYNQSISLRRP

SEQ ID NO: 2305 - protein, 11 aa, Homo sapiens
  SITE (1)..(11): One or more of the listed amino acids can be phosphorylated as set forth in the Tables
RRIDISPSTLR

SEQ ID NO: 2306 - protein, 12 aa, Homo sapiens
  SITE (1)..(12): One or more of the listed amino acids can be phosphorylated as set forth in the Tables
RRIDISPSTLRK

SEQ ID NO: 2307 - protein, 9 aa, Homo sapiens
  SITE (1)..(9): One or more of the listed amino acids can be phosphorylated as set forth in the Tables
RAKSPISLK

SEQ ID NO: 2308 - protein, 13 aa, Homo sapiens
  SITE (1)..(13): One or more of the listed amino acids can be phosphorylated as set forth in the Tables
ESSVRSQEDQLSR

SEQ ID NO: 2309 - protein, 14 aa, Homo sapiens
  SITE (1)..(14): One or more of the listed amino acids can be phosphorylated as set forth in the Tables
ESSVRSQEDQLSRR

SEQ ID NO: 2310 - protein, 15 aa, Homo sapiens
  SITE (1)..(15): One or more of the listed amino acids can be phosphorylated as set forth in the Tables
DKLSVIAEDSESGKQ

SEQ ID NO: 2311 - protein, 16 aa, Homo sapiens
  SITE (1)..(16): One or more of the listed amino acids can be phosphorylated as set forth in the Tables
DKLSVIAEDSESGKQN

SEQ ID NO: 2312 - protein, 17 aa, Homo sapiens
  SITE (1)..(17): One or more of the listed amino acids can be phosphorylated as set forth in the Tables
DKLSVIAEDSESGKQNP

SEQ ID NO: 2313 - protein, 18 aa, Homo sapiens
  SITE (1)..(18): One or more of the listed amino acids can be phosphorylated as set forth in the Tables
DKLSVIAEDSESGKQNPG

SEQ ID NO: 2314 - protein, 20 aa, Homo sapiens
  SITE (1)..(20): One or more of the listed amino acids can be phosphorylated as set forth in the Tables
DKLSVIAEDSESGKQNPGDS

SEQ ID NO: 2315 - protein, 15 aa, Homo sapiens
  SITE (1)..(15): One or more of the listed amino acids can be phosphorylated as set forth in the Tables
KLSVIAEDSESGKQN

SEQ ID NO: 2316 - protein, 16 aa, Homo sapiens
  SITE (1)..(16): One or more of the listed amino acids can be phosphorylated as set forth in the Tables
KLSVIAEDSESGKQNP

SEQ ID NO: 2317 - protein, 17 aa, Homo sapiens
  SITE (1)..(17): One or more of the listed amino acids can be phosphorylated as set forth in the Tables
KLSVIAEDSESGKQNPG

SEQ ID NO: 2318 - protein, 21 aa, Homo sapiens
  SITE (1)..(21): One or more of the listed amino acids can be phosphorylated as set forth in the Tables
NLELSKFRMPQPSSGRESPRH

SEQ ID NO: 2319 - protein, 18 aa, Homo sapiens
  SITE (1)..(18): One or more of the listed amino acids can be phosphorylated as set forth in the Tables
LSKFRMPQPSSGRESPRH

SEQ ID NO: 2320 - protein, 21 aa, Homo sapiens
  SITE (1)..(21): One or more of the listed amino acids can be phosphorylated as set forth in the Tables
PPLPEDSIKVIRNMRAASPPA

SEQ ID NO: 2321 - protein, 11 aa, Homo sapiens
  SITE (1)..(11): One or more of the listed amino acids can be phosphorylated as set forth in the Tables
RTMSEAALVRK

SEQ ID NO: 2322 - protein, 17 aa, Homo sapiens
  SITE (1)..(17): One or more of the listed amino acids can be phosphorylated as set forth in the Tables
MPRPSIKKAQNSQAARQ

SEQ ID NO: 2323 - protein, 20 aa, Homo sapiens
  SITE (1)..(20): One or more of the listed amino acids can be phosphorylated as set forth in the Tables
THKGEIRGASTPFQFRASSP

SEQ ID NO: 2324 - protein, 19 aa, Homo sapiens
  SITE (1)..(19): One or more of the listed amino acids can be phosphorylated as set forth in the Tables
HKGEIRGASTPFQFRASSP

SEQ ID NO: 2325 - protein, 10 aa, Homo sapiens
  SITE (1)..(10): One or more of the listed amino acids can be phosphorylated as set forth in the Tables
STIQNSPTKK

SEQ ID NO: 2326 - protein, 10 aa, Homo sapiens
  SITE (1)..(10): One or more of the listed amino acids can be phosphorylated as set forth in the Tables
RSYSPDHRQK

SEQ ID NO: 2327 - protein, 13 aa, Homo sapiens
  SITE (1)..(13): One or more of the listed amino acids can be phosphorylated as set forth in the Tables
FDKHTLGDSDNES

SEQ ID NO: 2328 - protein, 21 aa, Homo sapiens
  SITE (1)..(21): One or more of the listed amino acids can be phosphorylated as set forth in the Tables
EPASPAASISRLSGEQVDGKG

SEQ ID NO: 2329 - protein, 18 aa, Homo sapiens
  SITE (1)..(18): One or more of the listed amino acids can be phosphorylated as set forth in the Tables
SPAASISRLSGEQVDGKG

SEQ ID NO: 2330 - protein, 15 aa, Homo sapiens
  SITE (1)..(15): One or more of the listed amino acids can be phosphorylated as set forth in the Tables
ASISRLSGEQVDGKG

SEQ ID NO: 2331 - protein, 15 aa, Homo sapiens
  SITE (1)..(15): One or more of the listed amino acids can be phosphorylated as set forth in the Tables
ASISRLSGEQVDGKG

SEQ ID NO: 2332 - protein, 15 aa, Homo sapiens
  SITE (1)..(15): One or more of the listed amino acids can be phosphorylated as set forth in the Tables
ASISRLSGEQVDGKG

SEQ ID NO: 2333 - protein, 13 aa, Homo sapiens
  SITE (1)..(13): One or more of the listed amino acids can be phosphorylated as set forth in the Tables
TTKSVKALSSLHG

SEQ ID NO: 2334 - protein, 15 aa, Homo sapiens
  SITE (1)..(15): One or more of the listed amino acids can be phosphorylated as set forth in the Tables
TTKSVKALSSLHGDD

SEQ ID NO: 2335 - protein, 16 aa, Homo sapiens
  SITE (1)..(16): One or more of the listed amino acids can be phosphorylated as set forth in the Tables
TTKSVKALSSLHGDDQ

SEQ ID NO: 2336 - protein, 17 aa, Homo sapiens
  SITE (1)..(17): One or more of the listed amino acids can be phosphorylated as set forth in the Tables
TTKSVKALSSLHGDDQD

SEQ ID NO: 2337 - protein, 18 aa, Homo sapiens
  SITE (1)..(18): One or more of the listed amino acids can be phosphorylated as set forth in the Tables
TTKSVKALSSLHGDDQDS

SEQ ID NO: 2338 - protein, 14 aa, Homo sapiens
  SITE (1)..(14): One or more of the listed amino acids can be phosphorylated as set forth in the Tables
TKSVKALSSLHGDD

SEQ ID NO: 2339 - protein, 15 aa, Homo sapiens
  SITE (1)..(15): One or more of the listed amino acids can be phosphorylated as set forth in the Tables
TKSVKALSSLHGDDQ

SEQ ID NO: 2340 - protein, 16 aa, Homo sapiens
  SITE (1)..(16): One or more of the listed amino acids can be phosphorylated as set forth in the Tables
TKSVKALSSLHGDDQD

SEQ ID NO: 2341 - protein, 14 aa, Homo sapiens
  SITE (1)..(14): One or more of the listed amino acids can be phosphorylated as set forth in the Tables
KSVKALSSLHGDDQ

SEQ ID NO: 2342 - protein, 15 aa, Homo sapiens
  SITE (1)..(15): One or more of the listed amino acids can be phosphorylated as set forth in the Tables
KSVKALSSLHGDDQD

SEQ ID NO: 2343 - protein, 20 aa, Homo sapiens
  SITE (1)..(20): One or more of the listed amino acids can be phosphorylated as set forth in the Tables
TTKSVKALSSLHGDDQDSED

SEQ ID NO: 2344 - protein, 21 aa, Homo sapiens
  SITE (1)..(21): One or more of the listed amino acids can be phosphorylated as set forth in the Tables
TTKSVKALSSLHGDDQDSEDE

SEQ ID NO: 2345 - protein, 19 aa, Homo sapiens
  SITE (1)..(19): One or more of the listed amino acids can be phosphorylated as set forth in the Tables
KSVKALSSLHGDDQDSEDE

SEQ ID NO: 2346 - protein, 13 aa, Homo sapiens
  SITE (1)..(13): One or more of the listed amino acids can be phosphorylated as set forth in the Tables
KLVSFHDDSDEDL

SEQ ID NO: 2347 - protein, 12 aa, Homo sapiens
  SITE (1)..(12): One or more of the listed amino acids can be phosphorylated as set forth in the Tables
APSTYAHLSPAK

SEQ ID NO: 2348 - protein, 17 aa, Homo sapiens
  SITE (1)..(17): One or more of the listed amino acids can be phosphorylated as set forth in the Tables
APSTYAHLSPAKTPPPP

SEQ ID NO: 2349 - protein, 13 aa, Homo sapiens
  SITE (1)..(13): One or more of the listed amino acids can be phosphorylated as set forth in the Tables
NRAMRRVSSVPSR

SEQ ID NO: 2350 - protein, 15 aa, Homo sapiens
  SITE (1)..(15): One or more of the listed amino acids can be phosphorylated as set forth in the Tables
NRAMRRVSSVPSRAQ

SEQ ID NO: 2351 - protein, 19 aa, Homo sapiens
  SITE (1)..(19): One or more of the listed amino acids can be phosphorylated as set forth in the Tables
RPASPTAIRRIGSVTSRQT

SEQ ID NO: 2352 - protein, 19 aa, Homo sapiens
  SITE (1)..(19): One or more of the listed amino acids can be phosphorylated as set forth in the Tables
SGGDDDWTHLSSKEVDPST

SEQ ID NO: 2353 - protein, 20 aa, Homo sapiens
  SITE (1)..(20): One or more of the listed amino acids can be phosphorylated as set forth in the Tables
SGGDDDWTHLSSKEVDPSTG

SEQ ID NO: 2354 - protein, 21 aa, Homo sapiens
  SITE (1)..(21): One or more of the listed amino acids can be phosphorylated as set forth in the Tables
SGGDDDWTHLSSKEVDPSTGE

SEQ ID NO: 2355 - protein, 22 aa, Homo sapiens
  SITE (1)..(22): One or more of the listed amino acids can be phosphorylated as set forth in the Tables
SGGDDDWTHLSSKEVDPSTGEL

SEQ ID NO: 2356 - protein, 23 aa, Homo sapiens
  SITE (1)..(23): One or more of the listed amino acids can be phosphorylated as set forth in the Tables
SGGDDDWTHLSSKEVDPSTGELQ

SEQ ID NO: 2357 - protein, 17 aa, Homo sapiens
  SITE (1)..(17): One or more of the listed amino acids can be phosphorylated as set forth in the Tables
GGDDDWTHLSSKEVDPS

SEQ ID NO: 2358 - protein, 19 aa, Homo sapiens
  SITE (1)..(19): One or more of the listed amino acids can be phosphorylated as set forth in the Tables
GGDDDWTHLSSKEVDPSTG

SEQ ID NO: 2359 - protein, 14 aa, Homo sapiens
  SITE (1)..(14): One or more of the listed amino acids can be phosphorylated as set forth in the Tables
GDDDWTHLSSKEVD

SEQ ID NO: 2360 - protein, 15 aa, Homo sapiens
  SITE (1)..(15): One or more of the listed amino acids can be phosphorylated as set forth in the Tables
GDDDWTHLSSKEVDP

SEQ ID NO: 2361 - protein, 16 aa, Homo sapiens
  SITE (1)..(16): One or more of the listed amino acids can be phosphorylated as set forth in the Tables
GDDDWTHLSSKEVDPS

SEQ ID NO: 2362 - protein, 18 aa, Homo sapiens
  SITE (1)..(18): One or more of the listed amino acids can be phosphorylated as set forth in the Tables
GDDDWTHLSSKEVDPSTG

SEQ ID NO: 2363 - protein, 15 aa, Homo sapiens
  SITE (1)..(15): One or more of the listed amino acids can be phosphorylated as set forth in the Tables
DDDWTHLSSKEVDPS

SEQ ID NO: 2364 - protein, 17 aa, Homo sapiens
  SITE (1)..(17): One or more of the listed amino acids can be phosphorylated as set forth in the Tables
DDDWTHLSSKEVDPSTG

SEQ ID NO: 2365 - protein, 14 aa, Homo sapiens
  SITE (1)..(14): One or more of the listed amino acids can be phosphorylated as set forth in the Tables
DDWTHLSSKEVDPS

SEQ ID NO: 2366 - protein, 13 aa, Homo sapiens
  SITE (1)..(13): One or more of the listed amino acids can be phosphorylated as set forth in the Tables
DWTHLSSKEVDPS

SEQ ID NO: 2367 - protein, 15 aa, Homo sapiens
  SITE (1)..(15): One or more of the listed amino acids can be phosphorylated as set forth in the Tables
DWTHLSSKEVDPSTG

SEQ ID NO: 2368 - protein, 12 aa, Homo sapiens
  SITE (1)..(12): One or more of the listed amino acids can be phosphorylated as set forth in the Tables
WTHLSSKEVDPS

SEQ ID NO: 2369 - protein, 14 aa, Homo sapiens
  SITE (1)..(14): One or more of the listed amino acids can be phosphorylated as set forth in the Tables
WTHLSSKEVDPSTG

SEQ ID NO: 2370 - protein, 13 aa, Homo sapiens
  SITE (1)..(13): One or more of the listed amino acids can be phosphorylated as set forth in the Tables
GTLRRSDSQQAVK

SEQ ID NO: 2371 - protein, 14 aa, Homo sapiens
  SITE (1)..(14): One or more of the listed amino acids can be phosphorylated as set forth in the Tables
GTLRRSDSQQAVKS

SEQ ID NO: 2372 - protein, 16 aa, Homo sapiens
  SITE (1)..(16): One or more of the listed amino acids can be phosphorylated as set forth in the Tables
GTLRRSDSQQAVKSPP

SEQ ID NO: 2373 - protein, 12 aa, Homo sapiens
  SITE (1)..(12): One or more of the listed amino acids can be phosphorylated as set forth in the Tables
VLKSRKSSVTEE

SEQ ID NO: 2374 - protein, 9 aa, Homo sapiens
  SITE (1)..(9): The peptide is optionally O-GlcNAcylated
VLTSNVQTI

SEQ ID NO: 2375 - protein, 4 aa, Artificial Sequence
  Artificially synthesized peptide
RQAV

SEQ ID NO: 2376 - protein, 15 aa, Clostridium tetani
QYIKANSKFIGITEL

SEQ ID NO: 2377 - protein, 16 aa, Artificial Sequence
  Artificially synthesized tetanus peptide
AQYIKANSKFIGITEL

SEQ ID NO: 2378 - protein, 12 aa, Artificial Sequence
  Artificially synthesized PADRE peptide
  SITE (3)..(3): Xaa can be any naturally occurring amino acid
AKXVAAWTLKAA

SEQ ID NO: 2379 - protein, 11 aa, Artificial Sequence
  Artificially synthesized iodinated peptide
FLPSPDYFPSV

SEQ ID NO: 2380 - protein, 10 aa, Artificial Sequence
  Artificially synthesized cytomegalovirus peptide
TPRVTGGGAM

What is claimed is:

1. A composition comprising:
   (a) at least one synthetic target peptide, wherein each synthetic target peptide:
      (i) is between 8 and 50 amino acids long, and
      (ii) comprises an amino acid sequence selected from the group consisting of SEQ ID NOs: 2164-2167 and 2374; and
   (b) a therapeutically effective amount of an adjuvant.

2. The composition of claim 1, wherein at least one serine residue in at least one of the synthetic target peptides is replaced with a homo-serine.

3. The composition of claim 1, wherein the composition comprises at least 5 different peptides.

4. The composition of claim 1, further comprising at least one peptide derived from MelanA (MART-I), gp100 (Pmel 17), tyrosinase, TRP-1, TRP-2, MAGE-1, MAGE-3, BAGE, GAGE-1, GAGE-2, p15(58), CEA, RAGE, NY-ESO (LAGE), SCP-1, Hom/Mel-40, PRAME, p53, H-Ras, HER-2/neu, BCR-ABL, E2A-PRL, H4-RET, IGH-IGK, MYL-RAR, Epstein Barr virus antigens, EBNA, human papillomavirus (HPV) antigens E6 and E7, TSP-180, MAGE-4, MAGE-5, MAGE-6, p185erbB2, p180erbB-3, c-met, nm-23H1, PSA, TAG-72-4, CA 19-9, CA 72-4, CAM 17.1, NuMa, K-ras, β-Catenin, CDK4, Mum-1, p16, TAGE, PSMA, PSCA, CT7, telomerase, 43-9F, 5T4, 791Tgp72, alpha-fetoprotein, β-HCG, BCA225, BTAA, CA 125, CA 15-3 (CA 27.29\BCAA), CA 195, CA 242, CA-50, CAM43, CD68\KP1, CO-029, FGF-5, G250, Ga733 (EpCAM), HTgp-175, M344, MA-50, MG7-Ag, MOV18, NB/70K, NY-CO-1, RCAS1, SDCCAG16, TA-90 (Mac-2 binding protein\cyclophilin C-associated protein), TAAL6, TAG72, TLP and TPS.

5. The composition of claim 1, futher comprising an agent selected from the groupconsisting of anti-CTLA-4, vermurafenib, ipilimumab, dacarbazine, IL-2, temozolomide, imatinib, gefitinib, erlotinib, sunitinib, tyrphostins and telatinib.

6. The composition of claim 1, further comprising darcarbazine, carmustine and tamoxifen.

7. The composition of claim 1, wherein at least one of the synthetic target peptides is O-GlcNAcylated.

8. The composition of claim 1, wherein at least one of the synthetic target peptides comprises the amino acid sequence set forth in SEQ ID NO: 2164, wherein the serine at the fourth position in the sequence is O-GlcNAcylated.

9. The composition of claim 1, wherein at least one of the synthetic target peptides comprises the amino acid sequence set forth in SEQ ID NO: 2165, wherein the threonine at the fifth position in the sequence is O-GlcNAcylated.

10. The composition of claim 1, wherein at least one of the synthetic target peptides comprises the amino acid sequence set forth in SEQ ID NO: 2166, wherein the arginine at the first position in the sequence is mono-methylated and the threonine at the fifth position in the sequence is O-GlcNAcylated.

11. The composition of claim 1, wherein at least one of the synthetic target peptides comprises the amino acid sequence set forth in SEQ ID NO: 2167, wherein the arginine at the first position in the sequence is di-methylated and the threonine at the fifth position in the sequence is O-GlcNAcylated.

12. The composition of claim 1, wherein at least one of the synthetic target peptides comprises the amino acid sequence set forth in SEQ ID NO: 2374, wherein the serine at the fourth position in the sequence is O-GlcNAcylated.

13. The composition of claim 1, wherein composition has the ability to stimulate a T cell mediated immune response to at least one of the synthetic target peptides.

14. The composition of claim 1, wherein the adjuvant is selected from the group consisting of montanide ISA-51, QS-21, tetanus helper peptides, GM-CSF, cyclophosamide, bacillus Calmette-Guerin (BCG), corynbacterium parvum, levamisole, azimezone, isoprinisone, dinitrochlorobenezene (DNCB), keyhole limpet hemocyanins (KLH), incomplete Freunds adjuvant, complete Freunds adjuvant, mineral gels, aluminum hydroxide (Alum), lysolecithin, pluronic polyols, polyanions, peptides, oil emulsions, dinitrophenol, and diphtheria toxin (DT).

15. A composition comprising a synthetic target peptide and an adjuvant, wherein the synthetic target peptide is between 8 and 50 amino acids long and comprises the amino acid sequence set forth in SEQ ID NO: 2165.

16. The composition of claim 15, wherein the threonine at the fifth position of SEQ ID NO: 2165 is O-GlcNAcylated.

17. The composition of claim 15, wherein the adjuvant is QS-21.

18. The composition of claim 16, wherein the adjuvant is QS-21.

* * * * *